US012595515B2

(12) United States Patent
Maguer-Satta et al.

(10) Patent No.: US 12,595,515 B2
(45) Date of Patent: Apr. 7, 2026

(54) PROGNOSIS METHOD OF CANCER

(71) Applicants: CENTRE NATIONAL DE LA RECHERCHE SCIENTIFIQUE, Paris (FR); CENTRE LÉON BÉRARD, Lyons (FR); INSTITUT NATIONAL DE LA SANTÉ ET DE LA RECHERCHE MÉDICALE, Paris (FR); UNIVERSITÉ CLAUDE BERNARD LYON 1, Villeurbanne (FR)

(72) Inventors: Véronique Maguer-Satta, Bonnefamille (FR); Boris Guyot, Eveux (FR); Flora Clément, Grenoble (FR); Pierre Saintigny, Lyons (FR); Jean-Philippe Foy, Paris (FR); Emmanuel Delay, Lyons (FR)

(73) Assignees: CENTRE NATIONAL DE LA RECHERCHE SCIENTIFIQUE, Paris (FR); CENTRE LÉON BÉRARD, Lyons (FR); INSTITUT NATIONAL DE LA SANTÉ ET DE LA RECHERCHE MÉDICALE, Paris (FR); UNIVERSITÉ CLAUDE BERNARD LYON 1, Villeurbanne (FR)

( * ) Notice: Subject to any disclaimer, the term of this patent is extended or adjusted under 35 U.S.C. 154(b) by 1083 days.

(21) Appl. No.: 17/599,330

(22) PCT Filed: Mar. 27, 2020

(86) PCT No.: PCT/EP2020/058872
§ 371 (c)(1),
(2) Date: Sep. 28, 2021

(87) PCT Pub. No.: WO2020/201166
PCT Pub. Date: Oct. 8, 2020

(65) Prior Publication Data
US 2022/0186321 A1    Jun. 16, 2022

(30) Foreign Application Priority Data
Mar. 29, 2019    (EP) ..................................... 19305423

(51) Int. Cl.
*C12Q 1/6886*          (2018.01)
(52) U.S. Cl.
CPC ...... *C12Q 1/6886* (2013.01); *C12Q 2600/118* (2013.01); *C12Q 2600/158* (2013.01)

(58) Field of Classification Search
CPC ............ C12Q 1/6886; C12Q 2600/118; C12Q 2600/158
See application file for complete search history.

(56) References Cited

U.S. PATENT DOCUMENTS

2009/0149333 A1    6/2009    Knudsen et al.

FOREIGN PATENT DOCUMENTS

WO    2006/110264 A2    10/2006

OTHER PUBLICATIONS

Robinson et al., "A comparison of Affymetrix gene expression arrays," BMC Bioinformatics, vol. 8, pp. 1-16. (Year: 2007).*
Affymetrix Probe Set for Human Genome U133 Plus 2.0 (Year: 2015).*
International Search Report and Written Opinion issued on Jun. 17, 2020 in corresponding International Application No. PCT/EP2020/058872; 12 pages.
Christine Desmedt et al., "Characterization and Clinical Evaluation of CD10+ Stroma Cells in the Breast Cancer Microenvironment", Clinical Cancer Research, vol. 18, No. 4, Jan. 10, 2012, pp. 1004-1014.
Thi-Ngoc Diem Vo et al., "Prognostic impact of CD10 expression in clinical outcome of invasive breast carcinoma", Breast Cancer, vol. 22, No. 2, Apr. 11, 2013, pp. 117-128.
Patricia J. Keller et al., "Defining the cellular precursors to human breast cancer", Proceedings of the National Academy of Sciences (PNAS), vol. 109, No. 8, Sep. 21, 2011, pp. 2772-2777, 24 pages.
"Affymetrix GeneChip Human Genome U1333 Array Set HG-U133A", Geo, Mar. 11, 2002, 4 pages.
Eric Campeau et al., "A Versatile Viral System for Expression and Depletion of Proteins in Mammalian Cells", PLoS One, vol. 4, Issue 8, Aug. 2009, 18 pages.
Tom Dull et al., "A Third-Generation Lentivirus Vector with a Conditional Packaging System", Journal of Virology, vol. 72, No. 11, Nov. 1998, p. 8463-8471.

* cited by examiner

*Primary Examiner* — Angela M. Bartagna
*Assistant Examiner* — Francesca Filippa Giammona
(74) *Attorney, Agent, or Firm* — Maier & Maier, PLLC

(57) ABSTRACT

A method of prognosis of patient outcome and of the resistance to a chemotherapy treatment of an individual afflicted by a tumor. The method involves determining the amount of the product of each of at least 21 genes belonging to the group of 160 genes as set forth in SEQ ID NO: 1 to SEQ ID NO: 160.

1 Claim, 38 Drawing Sheets

Specification includes a Sequence Listing.

Figure 4

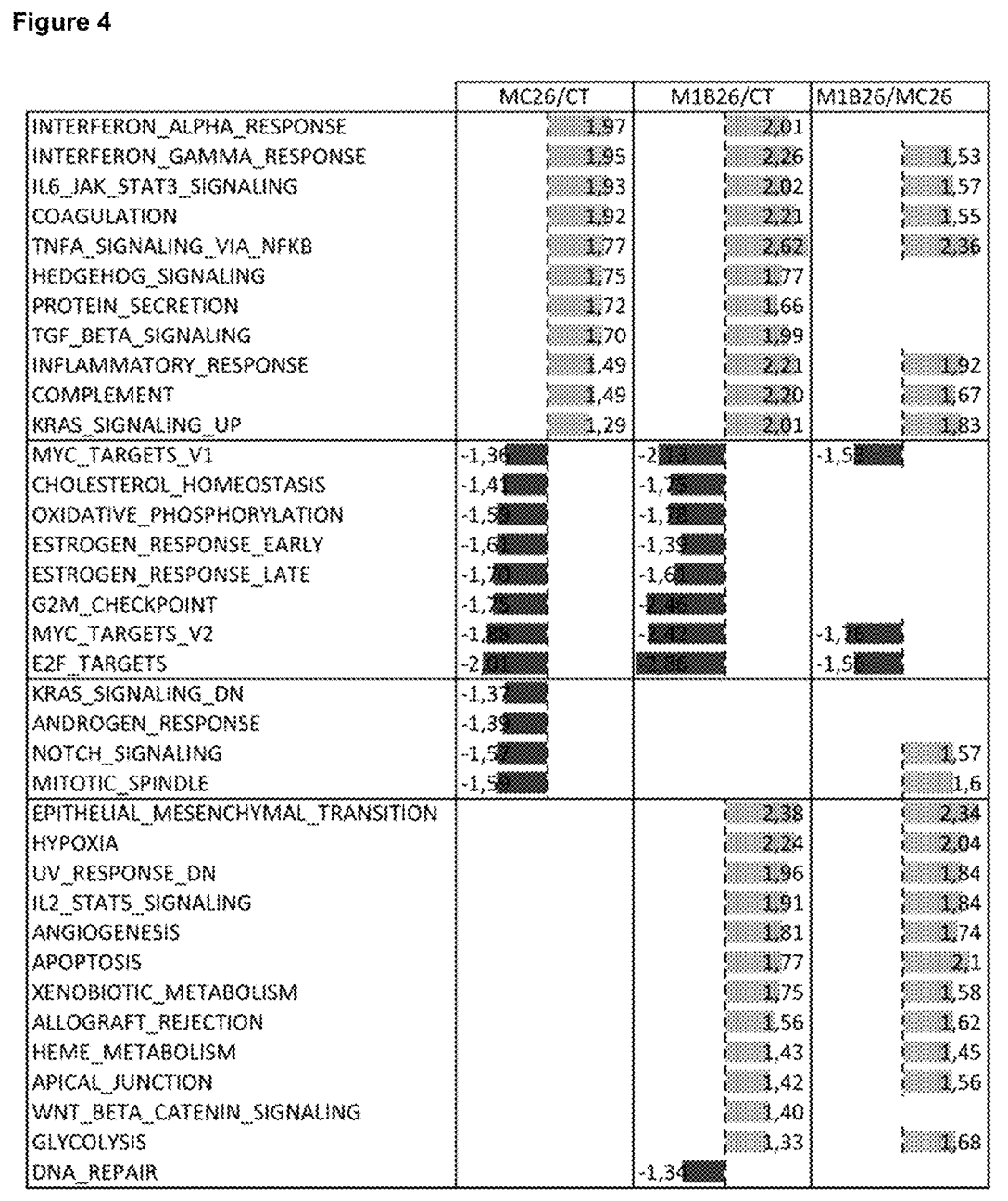

| | MC26/CT | M1826/CT | M1826/MC26 |
|---|---|---|---|
| INTERFERON_ALPHA_RESPONSE | 1,97 | 2,01 | |
| INTERFERON_GAMMA_RESPONSE | 1,95 | 2,26 | 1,53 |
| IL6_JAK_STAT3_SIGNALING | 1,93 | 2,02 | 1,57 |
| COAGULATION | 1,92 | 2,21 | 1,55 |
| TNFA_SIGNALING_VIA_NFKB | 1,77 | 2,62 | 2,36 |
| HEDGEHOG_SIGNALING | 1,75 | 1,77 | |
| PROTEIN_SECRETION | 1,72 | 1,66 | |
| TGF_BETA_SIGNALING | 1,70 | 1,99 | |
| INFLAMMATORY_RESPONSE | 1,49 | 2,21 | 1,92 |
| COMPLEMENT | 1,49 | 2,20 | 1,67 |
| KRAS_SIGNALING_UP | 1,29 | 2,01 | 1,83 |
| MYC_TARGETS_V1 | -1,36 | -2 | -1,5 |
| CHOLESTEROL_HOMEOSTASIS | -1,4 | -1,7 | |
| OXIDATIVE_PHOSPHORYLATION | -1,5 | -1, | |
| ESTROGEN_RESPONSE_EARLY | -1,6 | -1,3 | |
| ESTROGEN_RESPONSE_LATE | -1,7 | -1,6 | |
| G2M_CHECKPOINT | -1,7 | -1, | |
| MYC_TARGETS_V2 | -1, | -1, | -1, |
| E2F_TARGETS | -2 | -2 | -1,5 |
| KRAS_SIGNALING_DN | -1,3 | | |
| ANDROGEN_RESPONSE | -1,3 | | |
| NOTCH_SIGNALING | -1,5 | | 1,57 |
| MITOTIC_SPINDLE | -1,5 | | 1,6 |
| EPITHELIAL_MESENCHYMAL_TRANSITION | | 2,38 | 2,34 |
| HYPOXIA | | 2,24 | 2,04 |
| UV_RESPONSE_DN | | 1,96 | 1,84 |
| IL2_STATS_SIGNALING | | 1,91 | 1,84 |
| ANGIOGENESIS | | 1,81 | 1,74 |
| APOPTOSIS | | 1,77 | 2,1 |
| XENOBIOTIC_METABOLISM | | 1,75 | 1,58 |
| ALLOGRAFT_REJECTION | | 1,56 | 1,62 |
| HEME_METABOLISM | | 1,43 | 1,45 |
| APICAL_JUNCTION | | 1,42 | 1,56 |
| WNT_BETA_CATENIN_SIGNALING | | 1,40 | |
| GLYCOLYSIS | | 1,33 | 1,68 |
| DNA_REPAIR | | -1,34 | |

Figure 5
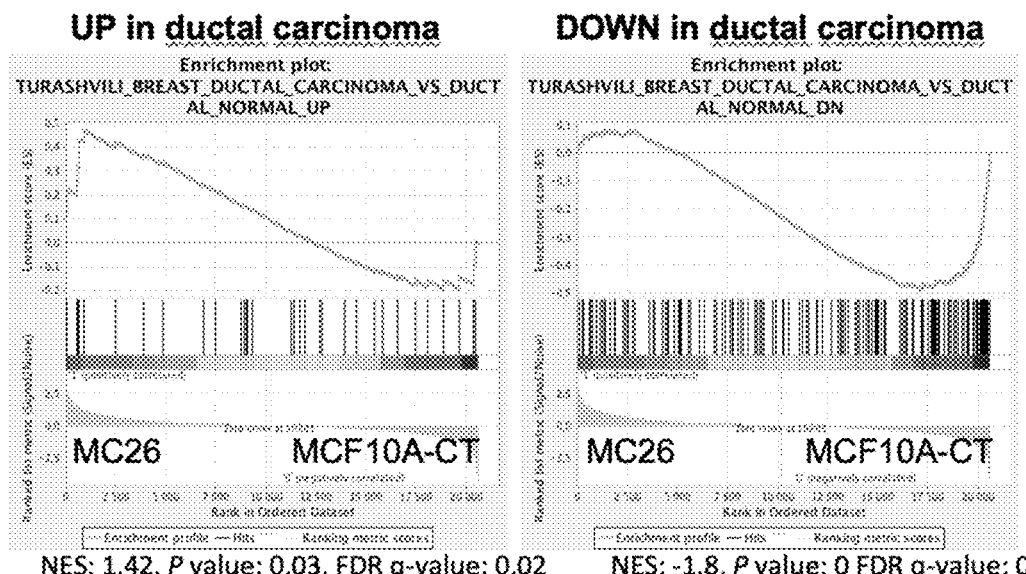
NES: 1.42, *P* value: 0.03, FDR q-value: 0.02     NES: -1.8, *P* value: 0 FDR q-value: 0
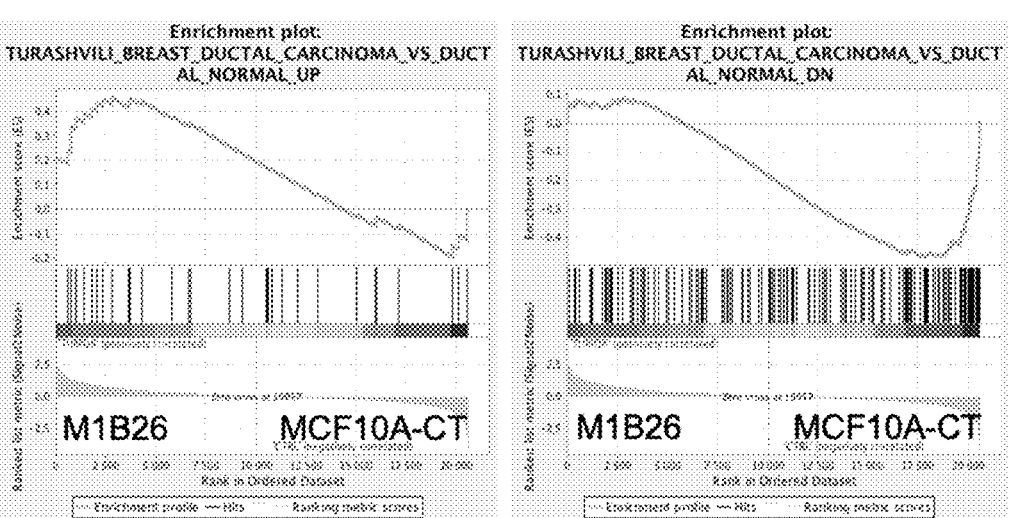
NES: 1.61, *P* value: 0.007, FDR q-value: 0.003    NES: -1.85, *P* value: 0, FDR q-value: 0

Figure 18

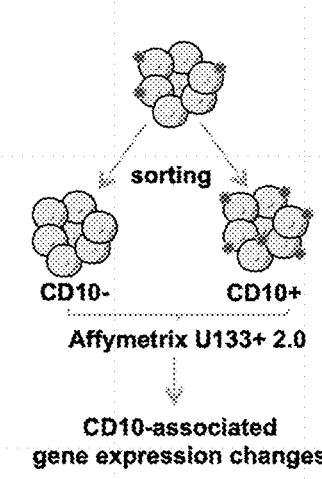

sorting

CD10-          CD10+

Affymetrix U133+ 2.0

CD10-associated
gene expression changes

Figure 19

| Cellular component | Biological process | Molecular function |
|---|---|---|
| Condensed chromosome kinetochore $(4,6^{\varepsilon}-7)$ | Sister chromatid cohesion $(7,4^{\varepsilon}-6)$ | Microtubule motor activity $(7,8^{\varepsilon}-3)$ |
| Kinetochore $(2,3^{\varepsilon}-6)$ | Chromosome segregation $(4,8^{\varepsilon}-4)$ | Microtubule binding $(8,3^{\varepsilon}-3)$ |
| Kinesin complex $(1,6^{\varepsilon}-4)$ | Microtubule-based movement $(6,4^{\varepsilon}-3)$ | |
| Microtubule $(2,1^{\varepsilon}-3)$ | Spindle organization $(1,2^{\varepsilon}-3)$ | |
| Spindle midzone $(8,2^{\varepsilon}-3)$ | Protein localization to kinetochore $(6,4^{\varepsilon}-3)$ | |

NES: 2.31, *P* value: 0,FDR q-value: 0

Figure 31
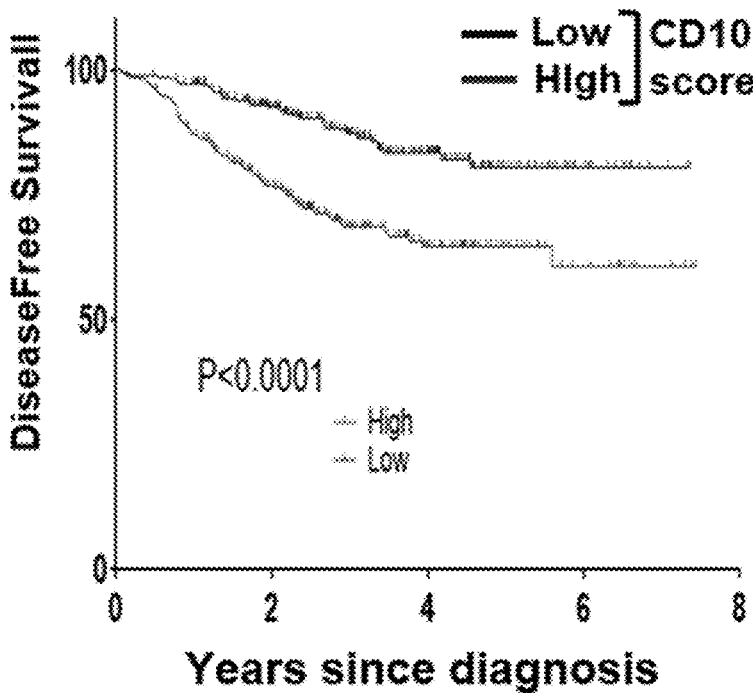
Figure 32
C4-2B CD10+ vs CD10-        22RV1 CD10+ vs CD10-
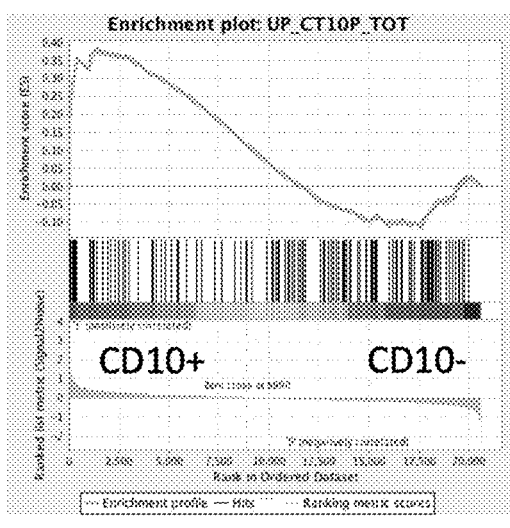 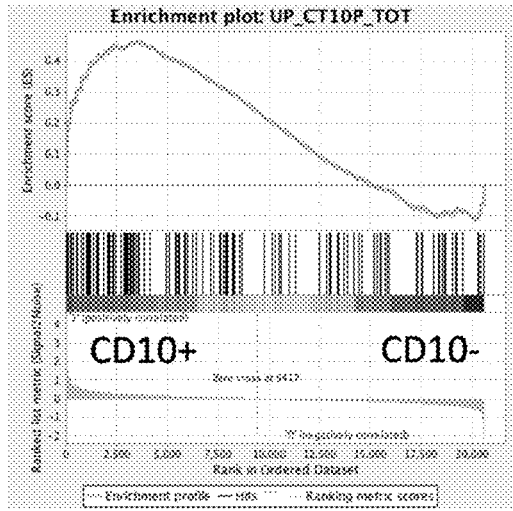
NES:1.6 ; *P* value: 0.002 ; FDR q-value: 0.002      NES: 1.8 ; *P* value: 0 ; FDR q-value: 0

1

PROGNOSIS METHOD OF CANCER

PRIORITY

This application, filed on Sep. 28, 2021, is a national stage application of PCT/EP2020/058872, filed on Mar. 27, 2020, which claims priority to foreign priority application EP19305423.6, filed on Mar. 29, 2019.

REFERENCE TO A SEQUENCE LISTING

In accordance with 37 CFR § 1.821, the present specification makes reference to a Sequence Listing submitted electronically as a .txt file named "Sequence_Listing.txt". The .txt file was generated on date of Jun. 4, 2019 and is 840,786 bytes in size. The entire contents of the Sequence Listing are hereby incorporated by reference.

FIELD

The present invention relates to a prognosis method of cancer.

BACKGROUND

Current cancer therapies kill most tumor cells, but fail to eradicate cancer stem cells (CSCs). These cells are commonly considered to be cancer cells with stem cell properties that contribute to therapeutic resistance and tumor escape through their ability to maintain self-renewal and generate tumor heterogeneity. The origin of CSCs is largely debated in the literature and numerous hypotheses and situations co-exist conditioned by tissue specificity and the level of investigation of the study. Furthermore, mounting evidence suggests that, besides intrinsic events, environmental factors from the stem cell (SC) niche might play an important role in the development of CSCs and their maintenance over time. These include signals initiated by cell-cell interactions, growth factors, cytokines, bio-active peptides generated by enzymatic activity, extracellular matrix, as well as biophysical influences.

In healthy adults, SCs sustain organ and tissue homeostasis and have been identified in the majority of tissues and organs, where they share common characteristics, including metabolic state, low cycling activity, DNA methylation pattern, DNA repair activity and expression of apoptotic cell death inhibitors, drug transporters, and membrane markers, as well as their location in specific tissue areas or "niches". All of these elements are suspected to provide SCs with a high level of resistance to stress and drugs, representing a hindrance in the context of cancer treatment. However, the specific targeting of CSCs remains challenging, since the cell surface markers used to distinguish them from non-CSC tumor cells are mostly expressed by normal SCs.

Their early stage identification and quantification within a tumor mass, essential for predicting tumor aggressiveness and adapting therapeutic strategies, remains an ongoing challenge.

SUMMARY

The invention intends to provide a new efficient mean to obviate prior art deficiencies.

The invention relates to a method of prognosis, preferably in vitro, of the outcome of a patient afflicted by a tumor, said method comprising:

a step of determining, in a sample of said tumor, the amount of the product of each of at least 21 genes belonging to the group of 160 genes as set forth in SEQ ID NO: 1 to SEQ ID NO: 160, said 21 genes being the genes of the group consisting of the genes as set forth in SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150 and SEQ ID NO: 160, a step of comparing said amount of the product of each of at least 21 genes determined in the previous step with the reference amount of each genes of the corresponding at least 21 genes from the group of 160 genes as set forth in SEQ ID NO: 1 to SEQ ID NO: 160, said reference amount being obtained from a biological sample different from said tumor, establishing a poor patient outcome when the ratio between the said amount and said reference amount is higher than or equal to 1.2, for each gene of said at least 21 genes.

BRIEF DESCRIPTION OF DRAWINGS

FIG. 4 is a table showing the gene set enrichment analysis (GSEA) analysis of transcriptomic data comparing MC26 (first column) or M1B26 (second column) to CT cells and M1B26 to MC26 cells (third column). The "hallmarks" gene sets from the MSigDB were used and the NES (Normalized Enrichment Score) with p value inferior to 0.05 are shown.

FIG. 5 shows the GSEA of transcriptomic data comparing MC26 cells (upper panels) or M1B26 cells (lower panels) to MCF10A-CT cells. Data represent enrichment plots analyzed using an open access geneset upregulated (left panels) or downregulated (right panels) in human primary ductal carcinoma compared to healthy tissues.

FIG. 18 represents the strategy used to identify the CD10 signature.

FIG. 19 represents a gene ontology table representing the main signaling pathways differentially expressed between CD10-positive and negative MCF10A cells. The CD10 signature genes were analysed for enrichment in GO terms using the DAVID functional annotation tool (david.ncifcrf.gov/). Enriched terms with a p value inferior to 0.01 after Benjamini correction for multiple tests (in brackets) are shown subdivided according to the GO subontology.

FIG. 31 represents a Kaplan-Meier plot of invasive breast cancer patients disease-free survival in function of CD10 signature ES from the same cohort than in FIG. 30.

FIG. 32 represents GSEA analysis of CD10 signature enrichment in FACS sorted CD10$^+$ and CD10$^-$ cells from the C4-2B (left panel) and 22RV1 (right panel) human prostate cancer cell lines.

SARC—total cohort: N=260—early grade 1: N=14

LIHC—total cohort: N=370—early grade 2: N=177

KIRC—total cohort: N=536—early grade 2: N=235

Figure 55:
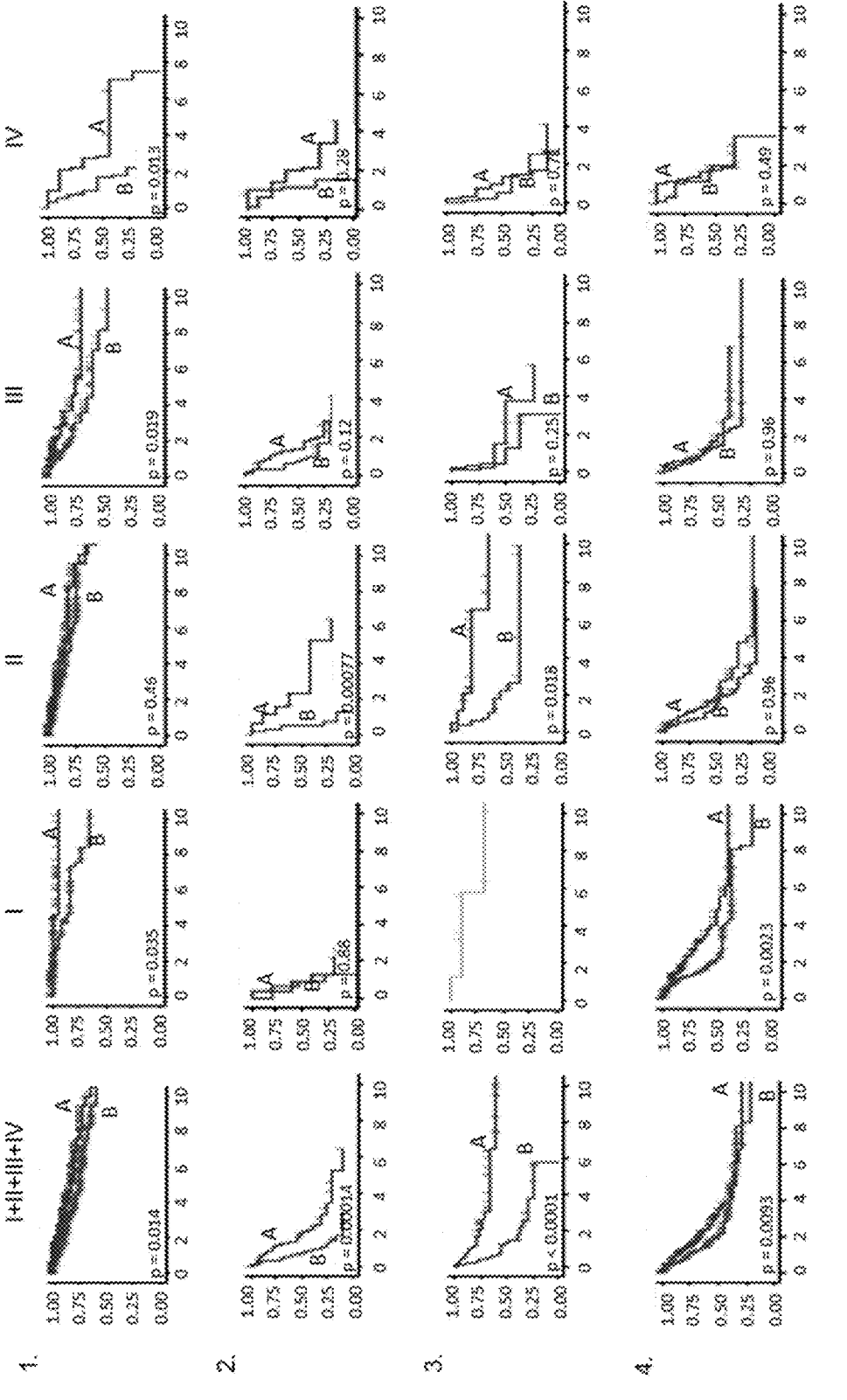

FIG. 55 Progression-free survival curves from the TCGA Pan-Cancer atlas estimated using the Kaplan-Meier method and compared with the Log-Rank test between groups of patients defined by the median of the signature enrichment score (low scores A and high scores B) for breast cancer (BRCA-1), Mesothelioma (MESO-2), Adenoid Cystic Carcinoma (ACC-3) and Lung Adenocarcinoma (LUAD-4). I: Stage I; II: Stage II; III: Stage III and IV: Stage IV. I+II+III+IV: All stages. X-axis: years since diagnosis; y-axis: survival.

Figure 56:
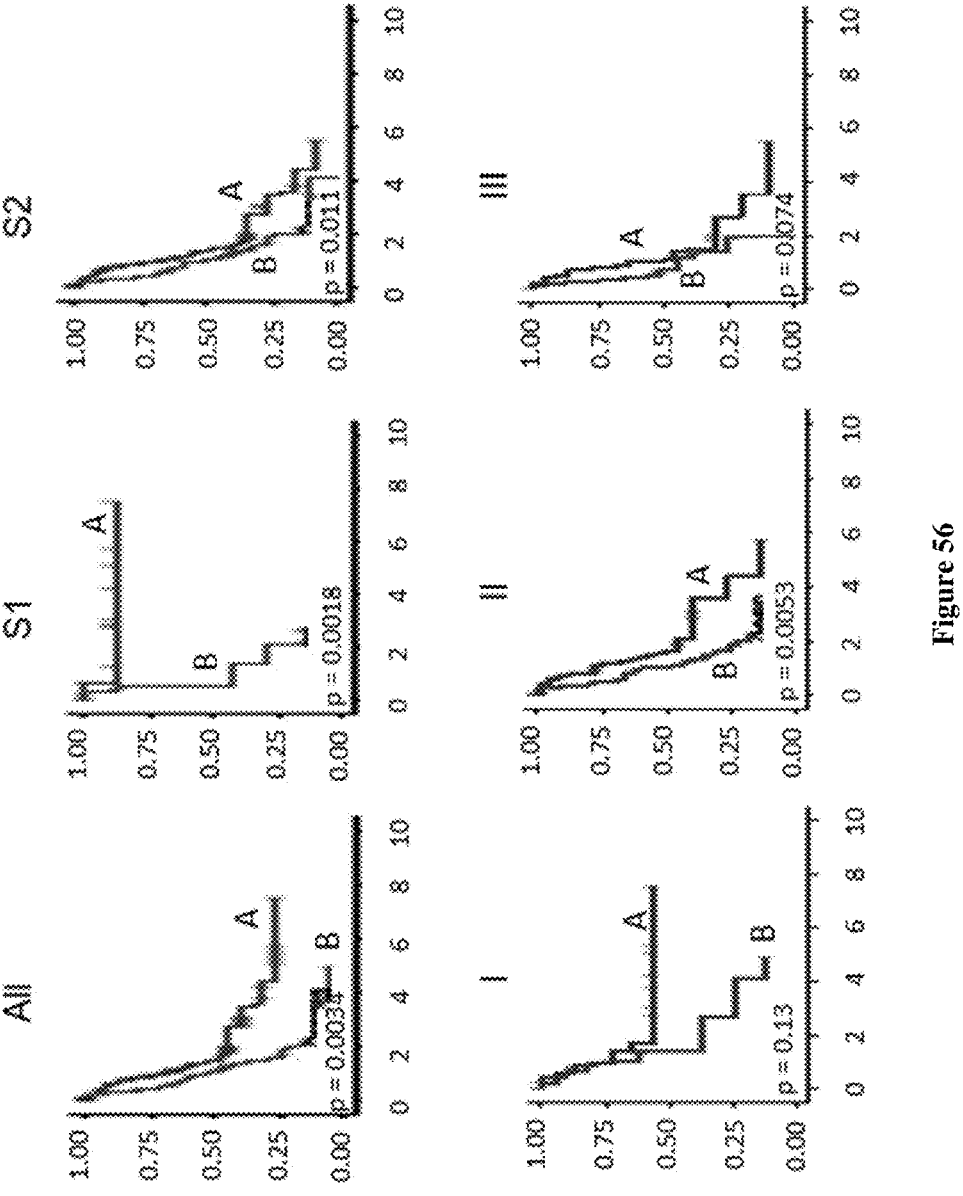

FIG. 56 Progression-free survival curves from the TCGA Pan-Cancer atlas estimated using the Kaplan-Meier method and compared with the Log-Rank test between groups of patients defined by the median of the signature enrichment score (low scores A and high scores B) for pancreatic adenocarcinoma in function of the stage (S1 and S2) and grade (I, II and Ill). All correspond to the results for all stages and grades.

DETAILED DESCRIPTION

The invention is based on the unexpected observation made by the inventors that sternness properties are conserved in transformed ih10-positive stem cells, and an associates molecular signature of 160 genes that are over expressed. The inventors identified that any combination of 21 genes among said 160 genes can predict efficiently the outcome of a large number of tumors.

Indeed, the inventors showed that when the expression level of at least 21 genes is equal to or higher to a ratio, compared to a control, 1.2, the patients will have a poor outcome, i.e. a reduced lifetime, possible relapse despite therapies, resistance to therapies.

In the invention, tumor should be understood as solid tumors or hematological tumors, such as leukemia, lymphomas and any related tumors involving hematopoietic cells.

In the invention the 160 genes are those disclosed in the following table.

TABLE 1

| SEQ ID NO: | Feature | Database # | Description |
|---|---|---|---|
| 1 | FAM83D | NM_030919.3 | family with sequence similarity 83, member D |
| 2 | TTK | NM_003318.5 | TTK protein kinase |
| 3 | PDZK1IP1 | NM_005764.4 | PDZK1 interacting protein 1 |
| 4 | FAM64A | NM_019013.3 | family with sequence similarity 64, member A |
| 5 | CENPA-SLC35F6 | NM_017877.4 | centromere protein A /// solute carrier family 35, member F6 |
| 6 | NUSAP1 | NM_016359.5 | nucleolar and spindle associated protein 1 |
| 7 | BUB1 | NM_004336.4 | BUB1 mitotic checkpoint serine/threonine kinase |
| 8 | DLGAP5 | NM_014750.5 | discs, large (*Drosophila*) homolog-associated protein 5 |
| 9 | PRC1 | NM_003981.4 | protein regulator of cytokinesis 1 |
| 10 | SGOL2 | NM_152524.6 | shugoshin-like 2 (*S. pombe*) |
| 11 | CDC25C | NM_001790.5 | cell division cycle 25C |
| 12 | SERPINE2 | NM_006216.3 | serpin peptidase inhibitor, clade E (nexin, plasminogen activator inhibitor type 1), member 2 |
| 13 | AOX1 | NM_001159.4 | aldehyde oxidase 1 |
| 14 | CDCA5 | NM_080668.4 | cell division cycle associated 5 |
| 15 | CDK1 | NM_001786.4 | cyclin-dependent kinase 1 |
| 16 | AKR1B10 | NM_020299.5 | aldo-keto reductase family 1, member B10 (aldose reductase) |
| 17 | DEPDC1 | NM_001114120.3 | DEP domain containing 1 |
| 18 | ANLN | NM_018685.5 | anillin, actin binding protein |
| 19 | C1S | NM_201442.3 | complement component 1, s subcomponent |
| 20 | CCDC71L | NM_175884.5 | coiled-coil domain containing 71-like |
| 21 | CKAP2L | NM_152515.5 | cytoskeleton associated protein 2-like |
| 22 | KIF20A | NM_005733.3 | kinesin family member 20A |
| 23 | DON | NM_001920.5 | decorin |
| 24 | SFTPB | NM_000542.4 | surfactant protein B |
| 25 | AKR1C1-AKR1C2-LOC101930400 | NM_001353.6 | aldo-keto reductase family 1, member C1 /// aldo-keto reductase family 1, member C2 /// aldo-keto reductase family 1 member C2-like |
| 26 | SPAG5 | NM_006461.4 | sperm associated antigen 5 |
| 27 | IL1R2 | NM_004633.4 | interleukin 1 receptor, type II |
| 28 | CCNA2 | NM_001237.5 | cyclin A2 |
| 29 | GAS2L3 | NM_174942.3 | growth arrest-specific 2 like 3 |
| 30 | AURKA | NM_198433.2 | aurora kinase A |
| 31 | KIF18B | NM_001265577.1 | kinesin family member 18B |
| 32 | GOLGA8A-GOLGA8B-LOC101930583 | NM_181077.3 | golgin A8 family, member A /// golgin A8 family, member B /// uncharacterized LOC101930583 |
| 33 | GALNT15 | NM_054110.5 | polypeptide N-acetylgalactosaminyltransferase 15 |
| 34 | TOP2A | NM_001067.4 | topoisomerase (DNA) II alpha 170 kDa |
| 35 | MME | NM_000902.3 | membrane metallo-endopeptidase |
| 36 | LCN2 | NM_005564.5 | lipocalin 2 |
| 37 | FBXO5 | NM_012177.5 | F-box protein 5 |
| 38 | S100P | NM_005980.3 | S100 calcium binding protein P |
| 39 | CXCL8 | NM_000584.4 | chemokine (C-X-C motif) ligand 8 |
| 40 | EHF | NM_001206616.1 | ets homologous factor |
| 41 | PI3 | NM_002638.4 | peptidase inhibitor 3, skin-derived |
| 42 | FPR1 | NM_001193306.1 | formyl peptide receptor 1 |
| 43 | RAB2A | NM_002865.3 | RAB2A, member RAS oncogene family |
| 44 | ESPL1 | NM_012291.4 | extra spindle pole bodies homolog 1 (*S. cerevisiae*) |
| 45 | FAP | NM_004460.5 | fibroblast activation protein, alpha |
| 46 | S100A7 | NM_002963.4 | S100 calcium binding protein A7 |
| 47 | DAPK1 | NM_004938.4 | death-associated protein kinase 1 |
| 48 | RPL37A | NM_000998.4 | ribosomal protein L37a |
| 49 | SPC24 | NM_182513.3 | SPC24, NDC80 kinetochore complex component |
| 50 | SCNN1G | NM_001039.4 | sodium channel, non-voltage-gated 1, gamma subunit |
| 51 | CONF | NM_001761.3 | cyclin F |
| 52 | AKR1B1 | NM_001628.4 | aldo-keto reductase family 1, member B1 (aldose reductase) |
| 53 | RANBP17 | NM_022897.5 | RAN binding protein 17 |
| 54 | IL1RL1 | NM_016232.4 | interleukin 1 receptor-like 1 |
| 55 | SUV39H1 | NM_001282166.1 | suppressor of variegation 3-9 homolog 1 (*Drosophila*) |

TABLE 1-continued

| SEQ ID NO: | Feature | Database # | Description |
|---|---|---|---|
| 56 | CENPA | NM_001809.4 | centromere protein A |
| 57 | EEF1D | NM_032378.5 | eukaryotic translation elongation factor 1 delta (guanine nucleotide exchange protein) |
| 58 | HJURP | NM_018410.5 | Holliday junction recognition protein |
| 59 | NCAPG | NM_022346.5 | non-SMC condensin I complex, subunit G |
| 60 | BUB1B | NM_001211.5 | BUB1 mitotic checkpoint serine/threonine kinase B |
| 61 | FAM76B | NM_144664.5 | family with sequence similarity 76, member B |
| 62 | ATP6V0E1 | NM_003945.4 | ATPase, H+ transporting, lysosomal 9 kDa, V0 subunit e1 |
| 63 | CYP1B1 | NM_000104.3 | cytochrome P450, family 1, subfamily B, polypeptide 1 |
| 64 | TMEM194A | NM_001130963.2 | transmembrane protein 194A |
| 65 | NDC80 | NM_006101.3 | NDC80 kinetochore complex component |
| 66 | KIF4A | NM_012310.5 | kinesin family member 4A |
| 67 | AURKB | NM_004217.4 | aurora kinase B |
| 68 | CCNB1 | NM_031966.4 | cyclin B1 |
| 69 | KIF2C | NM_006845.4 | kinesin family member 2C |
| 70 | NCAPH | NM_015341.5 | non-SMC condensin I complex, subunit H |
| 71 | NEURL1B | NM_001142651.2 | neuralized E3 ubiquitin protein ligase 1B |
| 72 | ASPM | NM_018136.5 | asp (abnormal spindle) homolog, microcephaly associated (*Drosophila*) |
| 73 | DKK1 | NM_012242.4 | dickkopf WNT signaling pathway inhibitor 1 |
| 74 | PAPSS2 | NM_004670.3 | 3'-phosphoadenosine 5'-phosphosulfate synthase 2 |
| 75 | FOXQ1 | NM_033260.4 | forkhead box Q1 |
| 76 | HMMR | NM_001142556.2 | hyaluronan-mediated motility receptor (RHAMM) |
| 77 | UBE2C | NM_007019.4 | ubiquitin-conjugating enzyme E2C |
| 78 | MCM8 | NM_032485.5 | minichromosome maintenance complex component 8 |
| 79 | SMC4 | NM_005496.3 | structural maintenance of chromosomes 4 |
| 80 | DIAPH3 | NM_001042517.1 | diaphanous-related formin 3 |
| 81 | SRGN | NM_002727.4 | serglycin |
| 82 | CFB | NM_001710.5 | complement factor B |
| 83 | CENPE | NM_001813.2 | centromere protein E, 312 kDa |
| 84 | CKAP2 | NM_018204.5 | cytoskeleton associated protein 2 |
| 85 | ADRB2 | NM_000024.5 | adrenoceptor beta 2, surface |
| 86 | KIF14 | NM_014875.3 | kinesin family member 14 |
| 87 | KPNA2 | NM_001320611.1 | karyopherin alpha 2 (RAG cohort 1, importin alpha 1) |
| 88 | CENPF | NM_016343.4 | centromere protein F, 350/400 kDa |
| 89 | FAM72A-FAM72B-FAM72C-FAM72D | NM_001123168.2 | family with sequence similarity 72, member A /// family with sequence similarity 72, member B /// family with sequence similarity 72, member C /// family with sequence similarity 72, member D |
| 90 | KCNK5 | NM_003740.4 | potassium channel, subfamily K, member 5 |
| 91 | CDCA3 | NM_031299.6 | cell division cycle associated 3 |
| 92 | COL8A1 | NM_001850.4 | collagen, type VIII, alpha 1 |
| 93 | CNTN3 | NM_020872.2 | contactin 3 (plasmacytoma associated) |
| 94 | CENPJ | NM_018451.5 | centromere protein J |
| 95 | SCNN1B | NM_000336.3 | sodium channel, non-voltage-gated 1, beta subunit |
| 96 | TACC3 | NM_006342.3 | transforming, acidic coiled-coil containing protein 3 |
| 97 | DEPDC1B | NM_018369.3 | DEP domain containing 1B |
| 98 | NCAPG2 | NM_017760.6 | non-SMC condensin II complex, subunit G2 |
| 99 | HSP90B1 | NM_003299.3 | heat shock protein 90 kDa beta (Grp94), member 1 |
| 100 | C1R | NM_001733.7 | complement component 1, r subcomponent |
| 101 | KIF23 | NM_138555.4 | kinesin family member 23 |
| 102 | SHCBP1 | NM_024745.5 | SHC SH2-domain binding protein 1 |
| 103 | NUCKS1 | NM_022731.5 | nuclear casein kinase and cyclin-dependent kinase substrate 1 |
| 104 | CEP55 | NM_018131.4 | centrosomal protein 55 kDa |
| 105 | COL12A1 | NM_004370.6 | collagen, type XII, alpha 1 |
| 106 | NCAPD3 | NM_015261.2 | non-SMC condensin II complex, subunit D3 |
| 107 | SUSD2 | NM_019601.4 | sushi domain containing 2 |
| 108 | GPR64 | NM_001079858.3 | G protein-coupled receptor 64 |
| 109 | ENO1 | NM_001428.5 | enolase 1, (alpha) |

TABLE 1-continued

| SEQ ID NO: | Feature | Database # | Description |
|---|---|---|---|
| 110 | METTL9 | NM_016025.5 | methyltransferase like 9 |
| 111 | CD59 | NM_203330.2 | CD59 molecule, complement regulatory protein |
| 112 | TMEM139 | NM_153345.3 | transmembrane protein 139 |
| 113 | FLRT3 | NM_013281.3 | fibronectin leucine rich transmembrane protein 3 |
| 114 | FIBIN | NM_203371.1 | fin bud initiation factor homolog (zebrafish) |
| 115 | ERAP1 | NM_016442.4 | endoplasmic reticulum aminopeptidase 1 |
| 116 | MGLL | NM_007283.6 | monoglyceride lipase |
| 117 | SNCAIP | NM_005460.4 | synuclein, alpha interacting protein |
| 118 | MLPH | NM_024101.7 | melanophilin |
| 119 | MKI67 | NM_002417.5 | marker of proliferation Ki-67 |
| 120 | TAF5 | NM_014409.3 | TAF5 RNA polymerase II, TATA box binding protein (TBP)-associated factor, 100 kDa |
| 121 | CASC5 | NM_170589.4 | cancer susceptibility candidate 5 |
| 122 | ORC6 | NM_014321.4 | origin recognition complex, subunit 6 |
| 123 | SAA2-SAA4 /// SAA4 | NM_030754.4 | SAA2-SAA4 readthrough /// serum amyloid A4, constitutive |
| 124 | FANCD2 | NM_033084.4 | Fanconi anemia, complementation group D2 |
| 125 | KANK2 | NM_015493.6 | KN motif and ankyrin repeat domains 2 |
| 126 | STIL | NM_001048166.1 | SCL/TAL1 interrupting locus |
| 127 | NAMPT | NM_005746.3 | nicotinamide phosphoribosyltransferase |
| 128 | IFI44L | NM_006820.4 | interferon-induced protein 44-like |
| 129 | NALCN | NM_001350748.1 | sodium leak channel, non-selective |
| 130 | FN1 | NM_212482.3 | fibronectin 1 |
| 131 | HEY1 | NM_012258.4 | hes-related family bHLH transcription factor with YRPW motif 1 |
| 132 | S1PR3 | NM_005226.4 | sphingosine-1-phosphate receptor 3 |
| 133 | SERPINA5 | NM_000624.6 | serpin peptidase inhibitor, clade A (alpha-1 antiproteinase, antitrypsin), member 5 |
| 134 | OSBPL7 | NM_145798.3 | oxysterol binding protein-like 7 |
| 135 | SAMSN1 | NM_022136.4 | SAM domain, SH3 domain and nuclear localization signals 1 |
| 136 | S100A4 | NM_002961.3 | S100 calcium binding protein A4 |
| 137 | SH3RF3 | NM_001099289.2 | SH3 domain containing ring finger 3 |
| 138 | TNFAIP6 | NM_007115.4 | tumor necrosis factor, alpha-induced protein 6 |
| 139 | CYP4B1 | NM_001099772.1 | cytochrome P450, family 4, subfamily B, polypeptide 1 |
| 140 | MASTL | NM_001172303.2 | microtubule associated serine/threonine kinase-like |
| 141 | NUDCD2 | NM_145266.6 | NudC domain containing 2 |
| 142 | CFLAR | NM_003879.7 | CASP8 and FADD-like apoptosis regulator |
| 143 | NEK2 | NM_002497.4 | NIMA-related kinase 2 |
| 144 | LOC100129518 /// SOD2 | NM_000636.4 | uncharacterized LOC100129518 /// superoxide dismutase 2, mitochondrial |
| 145 | ATAD2 | NM_014109.4 | ATPase family, AAA domain containing 2 |
| 146 | HPSE | NM_006665.5 | heparanase |
| 147 | SULT1E1 | NM_005420.3 | sulfotransferase family 1E, estrogen-preferring, member 1 |
| 148 | HMGB2 | NM_002129.3 | high mobility group box 2 |
| 149 | SPC25 | NM_020675.4 | SPC25, NDC80 kinetochore complex component |
| 150 | DDX17 | NM_006386.5 | DEAD (Asp-Glu-Ala-Asp) box helicase 17 |
| 151 | RPS27L | NM_015920.4 | ribosomal protein S27-like |
| 152 | CLIC3 | NM_004669.2 | chloride intracellular channel 3 |
| 153 | CCNG2 | NM_004354.3 | cyclin G2 |
| 154 | NNMT | NM_006169.2 | nicotinamide N-methyltransferase |
| 155 | LIMCH1 | NM_014988.4 | LIM and calponin homology domains 1 |
| 156 | DDIAS | NM_145018.4 | DNA damage-induced apoptosis suppressor |
| 157 | DAB2 /// LOC101926921 | NM_001343.4 | Dab, mitogen-responsive phosphoprotein, homolog 2 (*Drosophila*) /// uncharacterized LOC101926921 |
| 158 | PLSCR4 | NM_001128304.1 | phospholipid scramblase 4 |
| 159 | SLFN5 | NM_144975.4 | schlafen family member 5 |
| 160 | SLC39A8 | NM_022154.5 | solute carrier family 39 (zinc transporter), member 8 |

SEQ ID NO refer to the DNA molecules corresponding to the mRNA of the listed genes. Therefore, the sequence listed in the "sequence listing" does not correspond to RNA molecule but to DNA molecules.

Some of the genes listed in the above table are expressed as different variant due to alternative splicing. The invention is therefore not specifically limited to the sequences as set forces in the "sequence listing" but also encompasses the splicing variants of each listed genes.

According to the invention, at least 21 genes means 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159 or 160 genes.

In order to reduce the number of genes constituting the CD10 signature while maintaining its predictive power when using the 160 identified genes (SEQ ID NO: 1 to SEQ ID NO: 160), one can use the statistical approach called LASSO for Least Absolute Shrinkage and Selection Operator (web.stanford.edu/~hastie/glmnet/glmnet_alpha.html) .The LASSO minimizes the sum of squared errors, with an upper bound on the sum of the absolute values of the model parameters. Lambda>=0 is the parameter that controls the strength of the penalty, the larger the value of lambda, the greater the amount of shrinkage. The function glmnet.cv( ) helps to choose the most appropriate value for lambda. It performs k-fold cross-validation. According to a given criteria (deviance, missclassification error), minimal lambda (with minimum mean cross-validation error) and lambda_1se (model such that error is within 1 standard error of the minimum) can be obtained (cf. web.stanford.edu/ ~hastie/glmnet/glmnet_alpha.html). Once the best lambda value is chosen (lambda_min or lambda_1se), the model can be fitted using glmnet(x,y, best_lambda). Variables (genes) with 0-estimates are those that can be removed.

Figure 52:
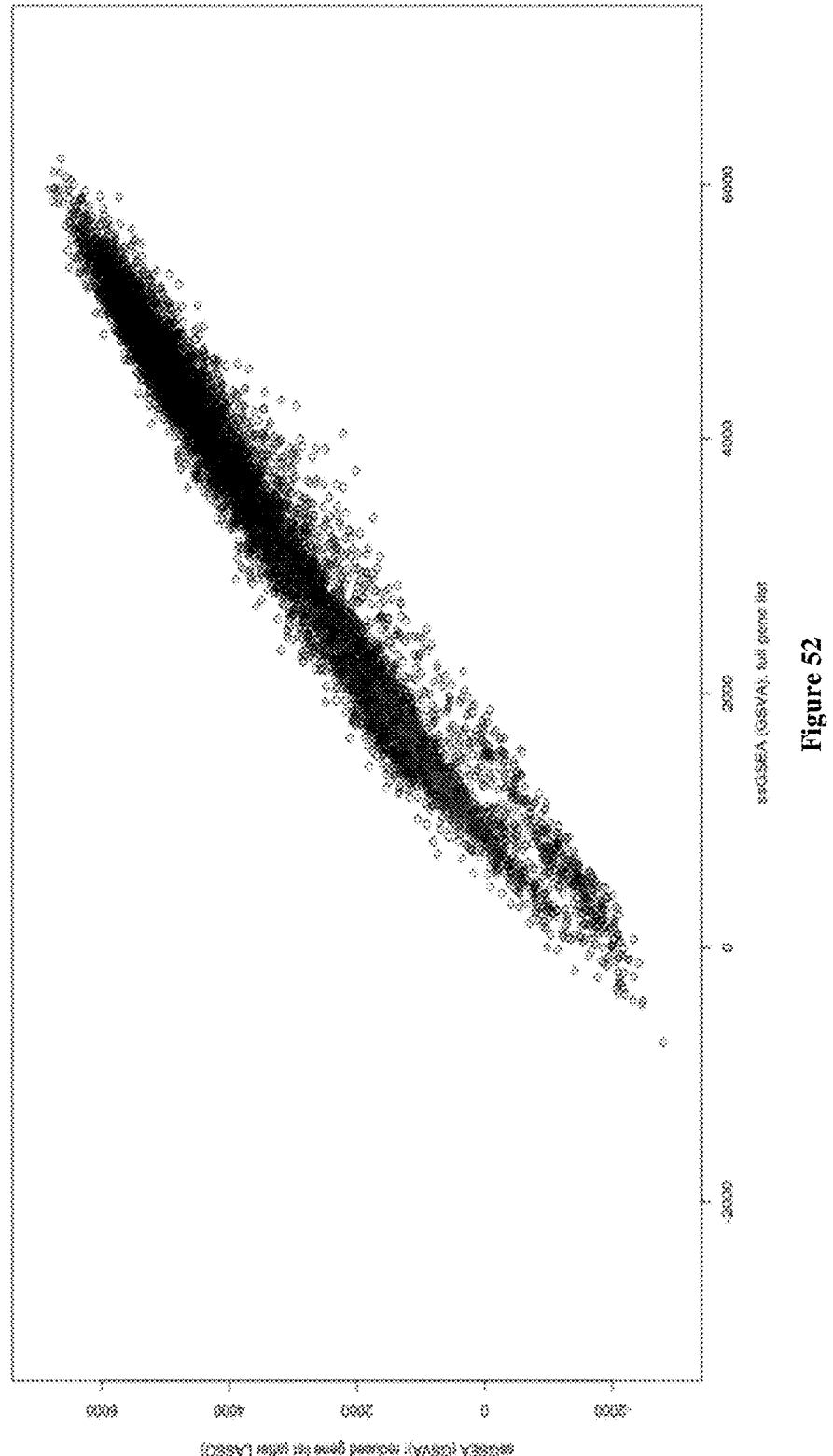

Using this approach, it is possible to reduce the CD10 signature to 82 genes. To evaluate the efficiency of this approach, we compared the ssGSEA score of the original CD10 signature and of the reduced CD10 signature from the transcriptomic data of the TCGA tumors and found a very good correlation with a Pearson correlation of 0.98 obtained (see FIG. 52). This shows that this approach efficiently decreased the number of genes in the CD10 signature without significantly changing the ssGSEA scores in the TCGA database, that are at the core of the calculation of the prognosis power of the signature.

By modulating the Lambda value of the LASSO method, it is possible, following the same strategy, to further decrease the number of genes in the signature.

Figure 53:
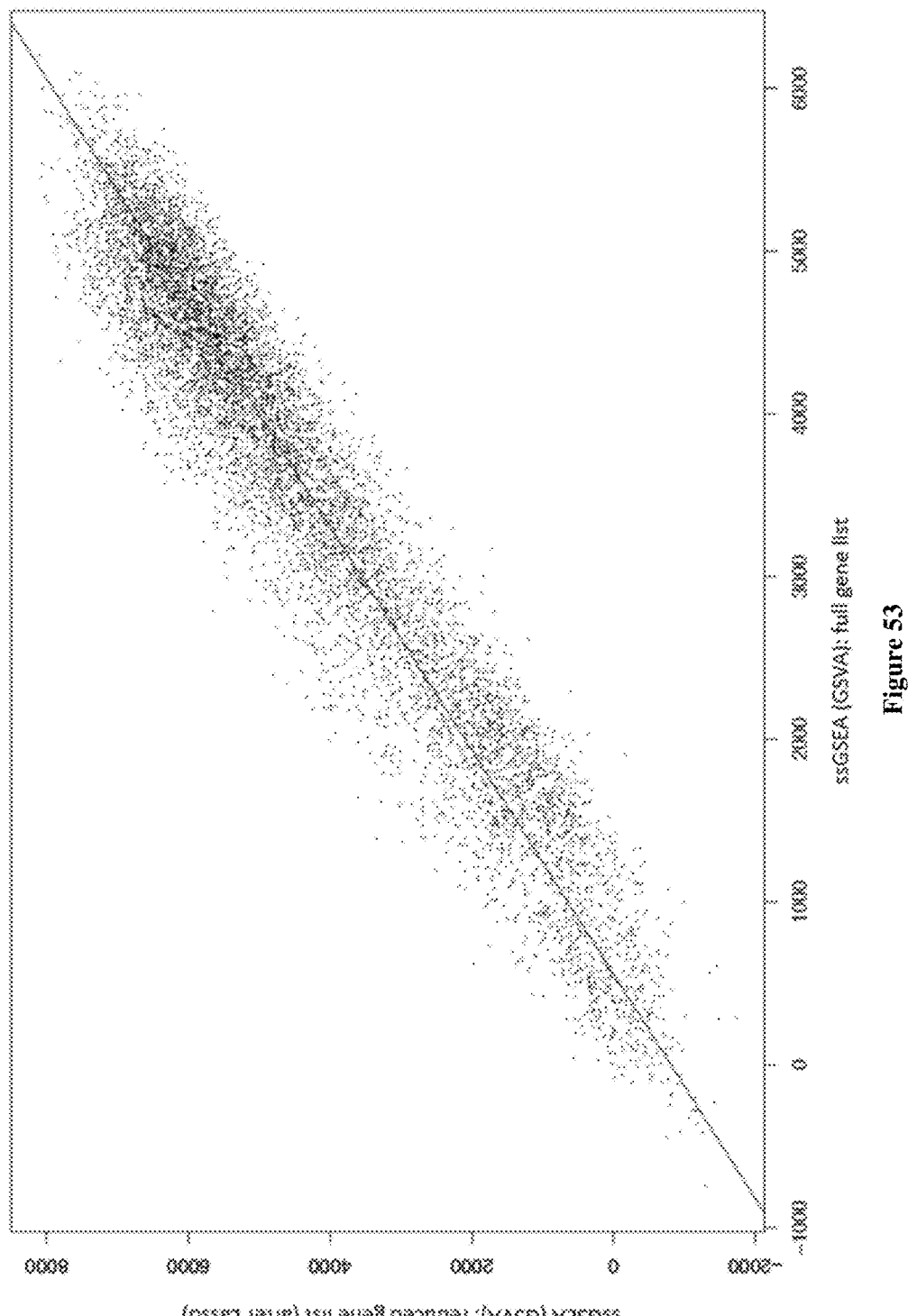
FIG. 53 Plot comparing the ssGSEA score for the full list of 160 genes and the ssGSEA score obtained for the reduced list of 21 genes. The Pearson coefficient is equal to 0.96, showing the effectiveness of the reduced signature compared to the original full signature.

It is also possible by the same strategy to reduce the signature to a specific and efficient group of 21 genes, said genes being the genes depicted in SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150 and SEQ ID NO: 160. There is a strong correlation between the ssGSEA score of the original CD10 signature and of the 21 genes CD10 signature from the transcriptomic data of the TCGA tumors with a Pearson correlation of 0.96 (see FIG. 53).

In the invention, the amount of the product of each gene is compared to the amount of each corresponding gene obtained from either a non-tumoral part of an organ afflicted by a tumor, or the same organ of a healthy individual.

For instance, if the gene SEQ ID NO: 1 is measured in a tumor of a patient, the ratio will be established by measuring the amount of the same gene (SEQ ID NO: 1) either in a sample which does not correspond to the tumor, or in a sample of the same organ, originating from a healthy individual. This is repeated for each of said at least 21 genes, such that at least 21 ratios can be calculated: Ratio i=amount of gene I in the tumor/amount of gene I in a control sample, I representing a determined gene.

Advantageously, the invention relates to method as defined above, said method comprising:
  a step of determining, in a biological sample of a tumor, the amount of the product of each of at least 82 genes belonging to the group of 160 genes as set forth in SEQ ID NO: 1 to SEQ ID NO: 160,
  a step of comparing said the amount of the product of each of at least 82 genes determined in the previous step with the reference amount of each genes of the corresponding at least 82 genes from the group of 160 genes as set forth in SEQ ID NO: 1 to SEQ ID NO: 160, said reference amount being obtained from a biological sample different from said tumor,
  establishing a poor patient outcome when the ratio between the said amount and said reference amount is higher than or equal to 1.2, for each gene of said at least 82 genes.
Non limitative examples of groups of at least 82 genes encompassed by the invention are:
  SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150, SEQ ID NO: 160, SEQ ID NO: 1, SEQ ID NO: 2, SEQ ID NO: 3, SEQ ID NO: 4, SEQ ID NO: 5, SEQ ID NO: 6, SEQ ID NO: 8, SEQ ID NO: 9, SEQ ID NO: 10, SEQ ID NO: 11, SEQ ID NO: 12, SEQ ID NO: 13, SEQ ID NO: 16, SEQ ID NO: 17, SEQ ID NO: 18, SEQ ID NO: 19, SEQ ID NO: 21, SEQ ID NO: 23, SEQ ID NO: 24, SEQ ID NO: 25, SEQ ID NO: 26, SEQ ID NO: 27, SEQ ID NO: 29, SEQ ID NO: 31, SEQ ID NO: 32, SEQ ID NO: 33, SEQ ID NO: 35, SEQ ID NO: 36, SEQ ID NO: 37, SEQ ID NO: 38, SEQ ID NO: 39, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70 and SEQ ID NO: 71.
  SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150, SEQ ID NO: 160, SEQ ID NO: 2, SEQ ID NO: 3, SEQ ID NO: 4, SEQ ID NO: 5, SEQ ID NO: 6, SEQ ID NO: 8, SEQ ID NO: 9, SEQ ID NO: 10, SEQ ID NO: 11, SEQ ID NO: 12, SEQ ID NO: 13, SEQ ID NO: 16, SEQ ID NO: 17, SEQ ID NO: 18, SEQ ID NO: 19, SEQ ID NO: 21, SEQ ID NO: 23, SEQ ID NO: 24, SEQ ID NO: 25, SEQ ID NO: 26, SEQ ID NO: 27, SEQ ID NO: 29, SEQ ID NO: 31, SEQ ID NO: 32, SEQ ID NO: 33, SEQ ID NO: 35, SEQ ID NO: 36, SEQ ID NO: 37, SEQ ID NO: 38, SEQ ID NO: 39, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71 and SEQ ID NO: 73, SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150, SEQ ID NO: 160, SEQ ID NO: 3, SEQ ID NO: 4, SEQ ID NO: 5, SEQ ID NO: 6, SEQ ID NO: 8, SEQ ID NO: 9, SEQ ID NO: 10, SEQ ID NO: 11, SEQ ID NO: 12, SEQ ID NO: 13, SEQ ID NO: 16, SEQ ID NO: 17, SEQ ID NO: 18, SEQ ID NO: 19, SEQ ID NO: 21, SEQ ID NO: 23, SEQ ID NO: 24, SEQ ID NO: 25, SEQ ID NO: 26, SEQ ID NO: 27, SEQ ID NO: 29, SEQ ID NO: 31, SEQ ID NO: 32, SEQ ID NO: 33, SEQ ID NO: 35, SEQ ID NO: 36, SEQ ID NO: 37, SEQ ID NO: 38, SEQ ID NO: 39, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 73 and SEQ ID NO: 74, SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150, SEQ ID NO: 160, SEQ ID NO: 4, SEQ ID NO: 5, SEQ ID NO: 6, SEQ ID NO: 8, SEQ ID NO: 9, SEQ ID NO: 10, SEQ ID NO: 11, SEQ ID NO: 12, SEQ ID NO: 13, SEQ ID NO: 16, SEQ ID NO: 17, SEQ ID NO: 18, SEQ ID NO: 19, SEQ ID NO: 21, SEQ ID NO: 23, SEQ ID NO: 24, SEQ ID NO: 25, SEQ ID NO: 26, SEQ ID NO: 27, SEQ ID NO: 29, SEQ ID NO: 31, SEQ ID NO: 32, SEQ ID NO: 33, SEQ ID NO: 35, SEQ ID NO: 36, SEQ ID NO: 37, SEQ ID NO: 38, SEQ ID NO: 39, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 73, SEQ ID NO: 74 and SEQ ID NO: 75, SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150, SEQ ID NO: 160, SEQ ID NO: 5, SEQ ID NO: 6, SEQ ID NO: 8, SEQ ID NO: 9, SEQ ID NO: 10, SEQ ID NO: 11, SEQ ID NO: 12, SEQ ID NO: 13, SEQ ID NO: 16, SEQ ID NO: 17, SEQ ID NO: 18, SEQ ID NO: 19, SEQ ID NO: 21, SEQ ID NO: 23, SEQ ID NO: 24, SEQ ID NO: 25, SEQ ID NO: 26, SEQ ID NO: 27, SEQ ID NO: 29, SEQ ID NO: 31, SEQ ID NO: 32, SEQ ID NO: 33, SEQ ID NO: 35, SEQ ID NO: 36, SEQ ID NO: 37, SEQ ID NO: 38, SEQ ID NO: 39, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 73, SEQ ID NO: 74, SEQ ID NO: 75 and SEQ ID NO: 77, SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150, SEQ ID NO: 160, SEQ ID NO: 6, SEQ ID NO: 8, SEQ ID NO: 9, SEQ ID NO: 10, SEQ ID NO: 11, SEQ ID NO: 12, SEQ ID NO: 13, SEQ ID NO: 16, SEQ ID NO: 17, SEQ ID NO: 18, SEQ ID NO: 19, SEQ ID NO: 21, SEQ ID NO: 23, SEQ ID NO: 24, SEQ ID NO: 25, SEQ ID NO: 26, SEQ ID NO: 27, SEQ ID NO: 29, SEQ ID NO: 31, SEQ ID NO: 32, SEQ ID NO: 33, SEQ ID NO: 35, SEQ ID NO: 36, SEQ ID NO: 37, SEQ ID NO: 38, SEQ ID NO: 39, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 73, SEQ ID NO: 74, SEQ ID NO: 75, SEQ ID NO: 77, and SEQ ID NO: 78, SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150, SEQ ID NO: 160, SEQ ID NO: 8, SEQ ID NO: 9, SEQ ID NO: 10, SEQ ID NO: 11, SEQ ID NO: 12, SEQ ID NO: 13, SEQ ID NO: 16, SEQ ID NO: 17, SEQ ID NO: 18, SEQ ID NO: 19, SEQ ID NO: 21, SEQ ID NO: 23, SEQ ID NO: 24, SEQ ID NO: 25, SEQ ID NO: 26, SEQ ID NO: 27, SEQ ID NO: 29, SEQ ID NO: 31, SEQ ID NO: 32, SEQ ID NO: 33, SEQ ID NO: 35, SEQ ID NO: 36, SEQ ID NO: 37, SEQ ID NO: 38, SEQ ID NO: 39, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 73, SEQ ID NO: 74, SEQ ID NO: 75, SEQ ID NO: 77, SEQ ID NO: 78 and SEQ ID NO: 79, SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150, SEQ ID NO: 160, SEQ ID NO: 9, SEQ ID NO: 10, SEQ ID NO: 11, SEQ ID NO: 12, SEQ ID NO: 13, SEQ ID NO: 16, SEQ ID NO: 17, SEQ ID NO: 18, SEQ ID NO: 19, SEQ ID NO: 21, SEQ ID NO: 23, SEQ ID NO: 24, SEQ ID NO: 25, SEQ ID NO: 26, SEQ ID NO: 27, SEQ ID NO: 29, SEQ ID NO: 31, SEQ ID NO: 32, SEQ ID NO: 33, SEQ ID NO: 35, SEQ ID NO: 36, SEQ ID NO: 37, SEQ ID NO: 38, SEQ ID NO: 39, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 73, SEQ ID NO: 74, SEQ ID NO: 75, SEQ ID NO: 77, SEQ ID NO: 78, SEQ ID NO: 79 and SEQ ID NO: 80, SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150, SEQ ID NO: 160, SEQ ID NO: 10, SEQ ID NO: 11, SEQ ID NO: 12, SEQ ID NO: 13, SEQ ID NO: 16, SEQ ID NO: 17, SEQ ID NO: 18, SEQ ID NO: 19, SEQ ID NO: 21, SEQ ID NO: 23, SEQ ID NO: 24, SEQ ID NO: 25, SEQ ID NO: 26, SEQ ID NO: 27, SEQ ID NO: 29, SEQ ID NO: 31, SEQ ID NO: 32, SEQ ID NO: 33, SEQ ID NO: 35, SEQ ID NO: 36, SEQ ID NO: 37, SEQ ID NO: 38, SEQ ID NO: 39, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 73, SEQ ID NO: 74, SEQ ID NO: 75, SEQ ID NO: 77, SEQ ID NO: 78, SEQ ID NO: 79, SEQ ID NO: 80 and SEQ ID NO: 81, SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150, SEQ ID NO: 160, SEQ ID NO: 11, SEQ ID NO: 12, SEQ ID NO: 13, SEQ ID NO: 16, SEQ ID NO: 17, SEQ ID NO: 18, SEQ ID NO: 19, SEQ ID NO: 21, SEQ ID NO: 23, SEQ ID NO: 24, SEQ ID NO: 25, SEQ ID NO: 26, SEQ ID NO: 27, SEQ ID NO: 29, SEQ ID NO: 31, SEQ ID NO: 32, SEQ ID NO: 33, SEQ ID NO: 35, SEQ ID NO: 36, SEQ ID NO: 37, SEQ ID NO: 38, SEQ ID NO: 39, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 73, SEQ ID NO: 74, SEQ ID NO: 75, SEQ ID NO: 77, SEQ ID NO: 78, SEQ ID NO: 79, SEQ ID NO: 80, SEQ ID NO: 81 and SEQ ID NO: 82, SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150, SEQ ID NO: 160, SEQ ID NO: 12, SEQ ID NO: 13, SEQ ID NO: 16, SEQ ID NO: 17, SEQ ID NO: 18, SEQ ID NO: 19, SEQ ID NO: 21, SEQ ID NO: 23, SEQ ID NO: 24, SEQ ID NO: 25, SEQ ID NO: 26, SEQ ID NO: 27, SEQ ID NO: 29, SEQ ID NO: 31, SEQ ID NO: 32, SEQ ID NO: 33, SEQ ID NO: 35, SEQ ID NO: 36, SEQ ID NO: 37, SEQ ID NO: 38, SEQ ID NO: 39, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 73, SEQ ID NO: 74, SEQ ID NO: 75, SEQ ID NO: 77, SEQ ID NO: 78, SEQ ID NO: 79, SEQ ID NO: 80, SEQ ID NO: 81, SEQ ID NO: 82 and SEQ ID NO: 83, etc.

The skilled person can easily determine all the combination of at least 82 genes according to the invention.

An advantageous group of 82 genes is the following one SEQ ID NO: 1, SEQ ID NO: 2, SEQ ID NO: 3, SEQ ID NO: 6, SEQ ID NO: 7, SEQ ID NO: 8, SEQ ID NO: 11, SEQ ID NO: 14, SEQ ID NO: 15, SEQ ID NO: 16, SEQ ID NO: 19, SEQ ID NO: 20, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 30, SEQ ID NO: 32, SEQ ID NO: 34, SEQ ID NO: 35, SEQ ID NO: 36, SEQ ID NO: 38, SEQ ID NO: 39, SEQ ID NO: 40, SEQ ID NO: 41, SEQ ID NO: 45, SEQ ID NO: 46, SEQ ID NO: 47, SEQ ID NO: 50, SEQ ID NO: 54, SEQ ID NO: 56, SEQ ID NO: 58, SEQ ID NO: 60, SEQ ID NO: 65, SEQ ID NO: 67, SEQ ID NO: 69, SEQ ID NO: 72, SEQ ID NO: 73, SEQ ID NO: 74, SEQ ID NO: 75, SEQ ID NO: 76, SEQ ID NO: 77, SEQ ID NO: 79, SEQ ID NO: 81, SEQ ID NO: 82, SEQ ID NO: 91, SEQ ID NO: 92, SEQ ID NO: 95, SEQ ID NO: 97, SEQ ID NO: 99, SEQ ID NO: 100, SEQ ID NO: 101, SEQ ID NO: 102, SEQ ID NO: 104, SEQ ID NO: 105, SEQ ID NO: 107, SEQ ID NO: 108, SEQ ID NO: 112, SEQ ID NO: 113, SEQ ID NO: 119, SEQ ID NO: 122, SEQ ID NO: 123, SEQ ID NO: 127, SEQ ID NO: 130, SEQ ID NO: 133, SEQ ID NO: 134, SEQ ID NO: 136, SEQ ID NO: 138, SEQ ID NO: 141, SEQ ID NO: 145, SEQ ID NO: 146, SEQ ID NO: 147, SEQ ID NO: 149, SEQ ID NO: 150, SEQ ID NO: 153, SEQ ID NO: 154, SEQ ID NO: 158, SEQ ID NO: 159 and SEQ ID NO: 160.

As mentioned above at least 82 genes means 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159 or 160 genes.

More advantageously, the invention relates to method as defined above, said method comprising:

a step of determining, in a biological sample of said tumor, the amount of the product of each of at least 100 genes belonging to the group of 160 genes as set forth in SEQ ID NO: 1 to SEQ ID NO: 160, a step of comparing said the amount of the product of each of at least 100 genes determined in the previous step with the reference amount of each genes of the corresponding at least 100 genes from the group of 160 genes as set forth in SEQ ID NO: 1 to SEQ ID NO: 160, said reference amount being obtained from a biological sample different from said tumor, establishing a poor patient outcome when the ratio between the said amount and said reference amount is higher than or equal to 1.2, for each gene of said at least 100 genes.

In another advantageous embodiment, the invention relates to method as defined above, said method comprising:

a step of determining, in a biological sample of said tumor, the amount of the genes as set forth in SEQ ID NO: 1 to SEQ ID NO: 160, a step of comparing said the amount of the product of each of said 160 genes determined in the previous step with the reference amount of each gene of the corresponding 160 genes as set forth in SEQ ID NO: 1 to SEQ ID NO: 160, said reference amount being obtained from a biological sample different from said tumor, establishing a poor patient outcome when the ratio between the said amount and said reference amount is higher than or equal to 1.2, for each gene of said 160 genes.

The invention also relates to a method of prognosis/prevision, preferably in vitro, of the resistance to a chemotherapy treatment of an individual afflicted by a tumor, preferably said chemotherapy treatment being one of the following treatment: a treatment with Nutlin-3a, with 17-AAG, with AZD8055, with Temsirolimus, with EHT 1864, with PF-4708671 or with ATRA said method comprising:

a step of determining, in a sample of said tumor, the amount of the product of each of at least 21 genes belonging to the group of 160 genes as set forth in SEQ ID NO: 1 to SEQ ID NO: 160, said 21 genes being the genes of the group consisting of the genes as set forth in SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150 and SEQ ID NO: 160, a step of comparing said amount of the product of each of at least 21 genes determined in the previous step with the reference amount of each gene of the corresponding at least 21 genes from the group of 160 genes as set forth in SEQ ID NO: 1 to SEQ ID NO: 160, said reference amount being obtained from a biological sample different from said tumor, establishing the resistance to a chemotherapy of said biological sample, when the ratio between the said amount and said reference amount is higher than or equal to 1.2, for each gene of said at least 21 genes.

The inventors also identify that the resistance to a therapy can be predicted, or estimated, by using the method defined above, i.e. if at least 21 of the 160 above mentioned genes have a ratio, as defined above, higher or equal to 1.2, the tumor will have a high risk to be resistant to a chemotherapy.

Such a method is important to the physician because he can adapt the therapy of a cancer taking account of the putative resistance to known molecules.

Advantageously, the invention relates to the method defined above, said method comprising:

a step of determining, in a biological sample of said tumor, the amount of the product of each of at least 82 genes belonging to the group of 160 genes as set forth in SEQ ID NO: 1 to SEQ ID NO: 160, a step of comparing said the amount of the product of each of at least 82 genes determined in the previous step with the reference amount of each gene of the corresponding at least 82 genes from the group of 160 genes as set forth in SEQ ID NO: 1 to SEQ ID NO: 160, said reference amount being obtained from a biological sample different from said tumor, establishing the resistance to a chemotherapy of said biological sample, when the ratio between the said amount and said reference amount is higher than or equal to 1.2, for each gene of said at least 82 genes.

Advantageously, the invention relates to the method above defined, said method comprising:

a step of determining, in a biological sample of said tumor, the amount of the product of each of at least 100 genes belonging to the group of 160 genes as set forth in SEQ ID NO: 1 to SEQ ID NO: 160, a step of comparing said the amount of the product of each of at least 100 genes determined in the previous step with the reference amount of each gene of the corresponding at least 100 genes from the group of 160 genes as set forth in SEQ ID NO: 1 to SEQ ID NO: 160, said reference amount being obtained from a biological sample different from said tumor,
establishing the resistance to a chemotherapy of said biological sample, when the ratio between the said amount and said reference amount is higher than or equal to 1.2, for each gene of said at least 100 genes.

Advantageously, the invention relates to the method above defined, said method comprising:

a step of determining, in a biological sample of said tumor, the amount of the genes as set forth in SEQ ID NO: 1 to SEQ ID NO: 160, a step of comparing said the amount of the product of each of said 160 genes determined in the previous step with the reference amount of each gene of the corresponding 160 genes as set forth in SEQ ID NO: 1 to SEQ ID NO: 160, said reference amount being obtained from a biological sample different from said tumor, establishing the resistance to a chemotherapy of said biological sample, when the ratio between the said amount and said reference amount is higher than or equal to 1.2, for each 160 genes.

In one other aspect, the invention relates to a method of prediction of the sensitivity to a chemotherapy treatment of an individual afflicted by a tumor, said chemotherapy treatment being one of the following treatment: a taxane-anthracycline chemotherapy, a treatment with PF-023410066, with AZD7762, with DMOG, with Thapsigarpin, with CHIR-99021, with AZD6244, vith JNJ26854165, with JNK-9L or with PF563371:

said method comprising:

a step of determining, in a sample of said tumor, the amount of the product of each of at least 21 genes belonging to the group of 160 genes as set forth in SEQ ID NO: 1 to SEQ ID NO: 160, Said 21 genes being the genes of the group consisting of the genes as set forth in SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150 and SEQ ID NO: 160, a step of comparing said amount of the product of each of at least 21 genes determined in the previous step with the reference amount of each gene of the corresponding at least 21 genes from the group of 160 genes as set forth in SEQ ID NO: 1 to SEQ ID NO: 160, said reference amount being obtained from a biological sample different from said tumor, establishing the sensitivity to a chemotherapy of said biological sample, when the ratio between the said amount and said reference amount is higher than or equal to 1.2, for each gene of said at least 21 genes, preferably said method comprising:

a step of determining, in a biological sample of said tumor, the amount of the product of each of at least 100 genes belonging to the group of 160 genes as set forth in SEQ ID NO: 1 to SEQ ID NO: 160, a step of comparing said the amount of the product of each of at least 100 genes determined in the previous step with the reference amount of each gene of the corresponding at least 100 genes from the group of 160 genes as set forth in SEQ ID NO: 1 to SEQ ID NO: 160, said reference amount being obtained from a biological sample different from said tumor, establishing the sensitivity to a chemotherapy of said biological sample, when the ratio between the said amount and said reference amount is higher than or equal to 1.2, for each gene of said at least 100 genes, more preferably said method comprising:

a step of determining, in a biological sample of said tumor, the amount of the genes as set forth in SEQ ID NO: 1 to SEQ ID NO: 160, a step of comparing said the amount of the product of each of said 160 genes determined in the previous step with the reference amount of each gene of the corresponding 160 genes as set forth in SEQ ID NO: 1 to SEQ ID NO: 160, said reference amount being obtained from a biological sample different from said tumor, establishing the sensitivity to a chemotherapy of said biological sample, when the ratio between the said amount and said reference amount is higher than or equal to 1.2, for each 160 genes.

More advantageously, the invention relates to the method defined above, wherein said tumor is a tumor selected from the list consisting of: Uveal Melanoma, Kidney Chromophobe, Kidney renal papillary cell carcinoma, Pancreatic adenocarcinoma, Adrenocortical carcinoma, Mesothelioma, Kidney renal clear cell carcinoma, Pheochromocytoma and Paraganglioma, Prostate adenocarcinoma, Brain Lower Grade Glioma, Thyroid carcinoma, Uterine Corpus Endometrial Carcinoma, Liver hepatocellular carcinoma, Sarcoma, Lung adenocarcinoma and Breast invasive carcinoma.

In a more advantageous embodiment, the invention relates to the method defined above, wherein the ratio for each gene is depicted in Table 2.

TABLE 2

| SEQ ID | Ratio |
|---|---|
| SEQ ID NO: 1 | 1.45299011594774 |
| SEQ ID NO: 2 | 1.63440150918581 |
| SEQ ID NO: 3 | 1.7553960465143 |
| SEQ ID NO: 4 | 1.52723079225544 |
| SEQ ID NO: 5 | 1.64946293180628 |
| SEQ ID NO: 6 | 1.44336182376005 |
| SEQ ID NO: 7 | 1.42542628033559 |
| SEQ ID NO: 8 | 1.60229422416717 |
| SEQ ID NO: 9 | 1.44940679303501 |
| SEQ ID NO: 10 | 1.51355284247764 |
| SEQ ID NO: 11 | 1.60284191957788 |
| SEQ ID NO: 12 | 1.45634180391828 |
| SEQ ID NO: 13 | 2.21437439451058 |
| SEQ ID NO: 14 | 1.43222142191884 |
| SEQ ID NO: 15 | 1.66661116356987 |
| SEQ ID NO: 16 | 1.43758422222593 |
| SEQ ID NO: 17 | 1.58695423854827 |
| SEQ ID NO: 18 | 1.50215367176723 |
| SEQ ID NO: 19 | 1.40110228215406 |
| SEQ ID NO: 20 | 1.5215835917325 |
| SEQ ID NO: 21 | 1.72316443862321 |
| SEQ ID NO: 22 | 1.51158832486644 |
| SEQ ID NO: 23 | 3.57134887691117 |
| SEQ ID NO: 24 | 2.71228137480607 |
| SEQ ID NO: 25 | 1.65791078609267 |
| SEQ ID NO: 26 | 1.4751138628455 |
| SEQ ID NO: 27 | 4.12099930267267 |
| SEQ ID NO: 28 | 1.45949451847513 |
| SEQ ID NO: 29 | 1.4480055789623 |
| SEQ ID NO: 30 | 1.55714451771423 |
| SEQ ID NO: 31 | 1.4939090907907 |
| SEQ ID NO: 32 | 1.44413788616626 |
| SEQ ID NO: 33 | 1.82649593759366 |

TABLE 2-continued

| SEQ ID | Ratio |
| --- | --- |
| SEQ ID NO: 34 | 1.56873136619678 |
| SEQ ID NO: 35 | 2.85387712409226 |
| SEQ ID NO: 36 | 1.77437733558316 |
| SEQ ID NO: 37 | 1.47117577047052 |
| SEQ ID NO: 38 | 1.30952286591512 |
| SEQ ID NO: 39 | 1.49973470641181 |
| SEQ ID NO: 40 | 1.9553274756006 |
| SEQ ID NO: 41 | 1.34324939094861 |
| SEQ ID NO: 42 | 2.22182965808712 |
| SEQ ID NO: 43 | 1.31763232102263 |
| SEQ ID NO: 44 | 1.32274520596085 |
| SEQ ID NO: 45 | 1.57131194595281 |
| SEQ ID NO: 46 | 2.44381316605462 |
| SEQ ID NO: 47 | 1.34128989500997 |
| SEQ ID NO: 48 | 1.16686017140665 |
| SEQ ID NO: 49 | 1.51634471828067 |
| SEQ ID NO: 50 | 1.4805308313359 |
| SEQ ID NO: 51 | 1.39242239772959 |
| SEQ ID NO: 52 | 1.29775809335653 |
| SEQ ID NO: 53 | 1.29631491932847 |
| SEQ ID NO: 54 | 2.97233515176399 |
| SEQ ID NO: 55 | 1.3821705159113 |
| SEQ ID NO: 56 | 1.29741555946967 |
| SEQ ID NO: 57 | 1.31915714046722 |
| SEQ ID NO: 58 | 1.46899924406752 |
| SEQ ID NO: 59 | 1.43112060132684 |
| SEQ ID NO: 60 | 1.54345355463842 |
| SEQ ID NO: 61 | 1.42064954434389 |
| SEQ ID NO: 62 | 1.31777387026315 |
| SEQ ID NO: 63 | 1.27913164685686 |
| SEQ ID NO: 64 | 1.26274175294231 |
| SEQ ID NO: 65 | 1.69955676557771 |
| SEQ ID NO: 66 | 1.35519209734731 |
| SEQ ID NO: 67 | 1.3411599203134 |
| SEQ ID NO: 68 | 1.58093148076625 |
| SEQ ID NO: 69 | 1.50307039471641 |
| SEQ ID NO: 70 | 1.39742661029759 |
| SEQ ID NO: 71 | 1.53917228503848 |
| SEQ ID NO: 72 | 1.41800541436761 |
| SEQ ID NO: 73 | 2.80946698653937 |
| SEQ ID NO: 74 | 1.68374877265343 |
| SEQ ID NO: 75 | 1.61583555009211 |
| SEQ ID NO: 76 | 1.57778020698301 |
| SEQ ID NO: 77 | 1.52743891908006 |
| SEQ ID NO: 78 | 1.48773871607028 |
| SEQ ID NO: 79 | 1.26656435050843 |
| SEQ ID NO: 80 | 1.30439763348159 |
| SEQ ID NO: 81 | 1.77237146757839 |
| SEQ ID NO: 82 | 2.01386627024136 |
| SEQ ID NO: 83 | 1.49399513151707 |
| SEQ ID NO: 84 | 1.30760564850088 |
| SEQ ID NO: 85 | 1.25459991574494 |
| SEQ ID NO: 86 | 1.47934034380497 |
| SEQ ID NO: 87 | 1.32087378166442 |
| SEQ ID NO: 88 | 1.37971936849403 |
| SEQ ID NO: 89 | 1.64819102140847 |
| SEQ ID NO: 90 | 1.3052085770855 |
| SEQ ID NO: 91 | 1.60276315719146 |
| SEQ ID NO: 92 | 1.44501553636631 |
| SEQ ID NO: 93 | 1.24452001509995 |
| SEQ ID NO: 94 | 1.34998425095694 |
| SEQ ID NO: 95 | 1.29148605847466 |
| SEQ ID NO: 96 | 1.33328492012454 |
| SEQ ID NO: 97 | 1.25959871513799 |
| SEQ ID NO: 98 | 1.32138906118674 |
| SEQ ID NO: 99 | 1.36905900209156 |
| SEQ ID NO: 100 | 1.32704406220548 |
| SEQ ID NO: 101 | 1.52697935713345 |
| SEQ ID NO: 102 | 1.73455267799112 |
| SEQ ID NO: 103 | 1.3331348533469 |
| SEQ ID NO: 104 | 1.52513055986719 |
| SEQ ID NO: 105 | 1.45918633466381 |
| SEQ ID NO: 106 | 1.22233247894788 |
| SEQ ID NO: 107 | 1.58679740877064 |
| SEQ ID NO: 108 | 1.24554500915433 |
| SEQ ID NO: 109 | 1.32812684852643 |
| SEQ ID NO: 110 | 1.26769151762895 |
| SEQ ID NO: 111 | 1.22385516178043 |

TABLE 2-continued

| SEQ ID | Ratio |
| --- | --- |
| SEQ ID NO: 112 | 1.34117995784871 |
| SEQ ID NO: 113 | 1.70342492196574 |
| SEQ ID NO: 114 | 1.55622173364245 |
| SEQ ID NO: 115 | 1.29193718196112 |
| SEQ ID NO: 116 | 1.28719588827798 |
| SEQ ID NO: 117 | 1.54737577795687 |
| SEQ ID NO: 118 | 1.32056580620687 |
| SEQ ID NO: 119 | 1.24291481161937 |
| SEQ ID NO: 120 | 1.25761677957559 |
| SEQ ID NO: 121 | 1.38138842743834 |
| SEQ ID NO: 122 | 1.35195892145423 |
| SEQ ID NO: 123 | 1.25493415929289 |
| SEQ ID NO: 124 | 1.33207938478519 |
| SEQ ID NO: 125 | 1.23994608622975 |
| SEQ ID NO: 126 | 1.40637153308311 |
| SEQ ID NO: 127 | 1.22340866433231 |
| SEQ ID NO: 128 | 1.78259257406418 |
| SEQ ID NO: 129 | 1.30643700928161 |
| SEQ ID NO: 130 | 2.03774927089618 |
| SEQ ID NO: 131 | 1.20686534436208 |
| SEQ ID NO: 132 | 2.08041781261265 |
| SEQ ID NO: 133 | 1.3067896040796 |
| SEQ ID NO: 134 | 1.28474550302269 |
| SEQ ID NO: 135 | 2.74456257890513 |
| SEQ ID NO: 136 | 1.37675140669605 |
| SEQ ID NO: 137 | 1.20894713337714 |
| SEQ ID NO: 138 | 1.69059109757586 |
| SEQ ID NO: 139 | 2.95952520678198 |
| SEQ ID NO: 140 | 1.51399870464451 |
| SEQ ID NO: 141 | 1.29362377903994 |
| SEQ ID NO: 142 | 1.3162354080269 |
| SEQ ID NO: 143 | 1.40699524525925 |
| SEQ ID NO: 144 | 1.21584998932997 |
| SEQ ID NO: 145 | 1.25286916985818 |
| SEQ ID NO: 146 | 1.22591310489464 |
| SEQ ID NO: 147 | 1.54499087928249 |
| SEQ ID NO: 148 | 1.22092592313041 |
| SEQ ID NO: 149 | 1.75119793576368 |
| SEQ ID NO: 150 | 1.24019794881152 |
| SEQ ID NO: 151 | 1.30587947147427 |
| SEQ ID NO: 152 | 1.50053521433644 |
| SEQ ID NO: 153 | 1.19766934161317 |
| SEQ ID NO: 154 | 1.38652354244453 |
| SEQ ID NO: 155 | 1.30528574261784 |
| SEQ ID NO: 156 | 1.58996555721118 |
| SEQ ID NO: 157 | 1.45190738641189 |
| SEQ ID NO: 158 | 1.23811413891419 |
| SEQ ID NO: 159 | 1.42872860499276 |
| SEQ ID NO: 160 | 1.67145004848207 |

The invention also relates to the use of pairs of oligo-nucleotides allowing the detection of at least 21 genes belonging to the group of 160 genes as set forth in SEQ ID NO: 1 to SEQ ID NO: 160, for carrying out the method as defined above, said 21 genes being the genes of the group consisting of the genes as set forth in SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150 and SEQ ID NO: 160.

The invention relates thus to a composition comprising pairs of oligonucleotides allowing the detection of at least 21 genes belonging to the group of 160 genes as set forth in SEQ ID NO: 1 to SEQ ID NO: 160, for its use for carrying out the method as defined above, and hereafter.

The invention also encompasses a method for evaluating, preferably in vitro, the efficiency of an anticancer drug, said method comprising the steps of:

a) determining, in a biological sample of a tumor previously treated with said anticancer drug, the amount of each of at least 21 genes belonging to the group of 160 genes as set forth in SEQ ID NO: 1 to SEQ ID NO: 160, said 21 genes being the genes of the group consisting of the genes as set forth in SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150 and SEQ ID NO: 160, b) a step of comparing said the amount of the product of each of at least 21 genes determined in the previous step with the reference amount of each gene of the corresponding at least 21 genes from the group of 160 genes as set forth in SEQ ID NO: 1 to SEQ ID NO: 160, said reference amount being obtained from a biological sample different from said tumor, c) establishing the efficiency of anticancer drug, when the ratio between the said amount and said reference amount, for each gene of said at least 21 genes is lower than or equal to 1.2.

In another aspect linked to the previously described methods, it is also possible to evaluate the effect of a therapy (or a compound) by carrying out a follow up of the ratios of said at least 21 genes.

If all the ratios are lower to 1.2, further to the treatment with a compound, it would be possible to state that the tumor is not resistant to said compound.

Otherwise, if the ratio of at least one gene is higher or equal to 1.2, a resistance could and may occur.

Advantageously, the invention relates to the method as defined above, wherein step a) essentially consists to) determining, in a biological sample of a tumor previously treated with said anticancer drug, the amount of each of at least 82 genes belonging to the group of 160 genes as set forth in SEQ ID NO: 1 to SEQ ID NO: 160.

Advantageously, the invention relates to the method as defined above, wherein step a) essentially consists in determining, in a biological sample of a tumor previously treated with said anticancer drug, the amount of each of at least 100 genes belonging to the group of 160 genes as set forth in SEQ ID NO: 1 to SEQ ID NO: 160.

Advantageously, the invention relates to the method as defined above, wherein step a) essentially consists in determining, in a biological sample of a tumor previously treated with said anticancer drug, the amount of the 160 genes as set forth in SEQ ID NO: 1 to SEQ ID NO: 160.

Example a CD10-Score Reflects Tumor Content in Stem-Like Cells and Predicts Patient Outcome in Solid Cancer Materials and Methods Animal experiments were authorized by the ethics committee for animal experimentation of the Rhone-Alpes region (CECCAPP), France, in the case of mammary cell lines and by the ethics committee for animal experimentation of Shanghai, China for prostate cell lines. Following long-term treatment with BMP2 and IL6, two million MCF10A MC26R or M1B26 cells, respectively, were mixed with 50% growth factor-reduced Matrigel (BD Biosciences) and injected subcutaneously close to the forth inguinal mammary gland of 6-7-week-old athymic nude mice (Harlan). Five mice were injected per group. A 10 mg/ml β-estradiol solution was applied to the neck region of the animals twice a week. Tumor formation was monitored by measuring the size of the tumor. Mice were sacrificed after 6 weeks, and tumors were fixed, paraffin-embedded, sectioned and subjected to H&E staining. For prostate cell lines, 105 C4-2B CD10$^+$ or CD10$^-$ cells were mixed with 50% growth factor-reduced Matrigel (BD Biosciences) and injected subcutaneously, respectively on the left or the right of immunodeficient mice. Tumor growth was measured over the time, and after 6 weeks, mice were sacrificed, and tumor collected.

Cell Isolation, Culture and Breast Cancer Transformation Model

Primary cells were obtained from human adult breast reduction mammoplasty cells or breast tumors (informed consent was obtained from the patients). MCF10A cells were purchased from the ATCC and cultured according to the manufacturer's recommendations in phenol red-free Dulbecco's modified Eagle's medium (DMEM)/F-12 nutrient mix supplemented with 5% horse serum (Life), 10 µg/ml insulin, 0.5 µg/ml hydrocortisone, 100 ng/ml cholera toxin and 20 ng/ml EGF (all supplied by Sigma), 1% penicillin/ streptomycin (Life Technologies). Exposure of MCF10A cells to BMP2 and IL6 (both at 10 ng/ml) led to the generation of the MC26 cell line that mimic luminal breast tumors1. Since the inventors showed that BMP2-mediated transformation was dependent on BMPR1B expression, the inventors also used sorted BMPR1B+MCF10A cells, in that case transformation was observed after only a few weeks of BMP2 and IL6 treatment. Three soft-agar clones from these BMP2/IL-6 treated BMPR1B+MCF10A cells selected picked and expanded in the presence of BMP2/IL-6, giving rise to the M1B26 cell line.

Functional Assay in Cell Lines

For mammosphere assays, single cells were seeded onto 96-well ultra-low attachment plates (BD Corning) at limiting dilutions (100 cells/96-well plate) for 7 days using the described sphere assay protocol3. Resulting spheres were counted. For the epithelial colony-forming cells (E-CFC) assay, cells were seeded in MCF10A 2% serum medium at a limiting dilution (250 cells/12-well plate) on an irradiated fibroblasts layer for 7 days, and resulting colonies were counted and classified using size and shape criteria as described in3-5. For 3D TLDU assays, 500 cells were seeded in growth factor-reduced Matrigel (BD Corning), and assay were carried out in complete medium2. Analysis of 3D structures and all other assays were performed using Axiovert 25 microscope (Zeiss), and images were analyzed with AxioVision 4.6 software. Structures were then washed with PBS 1×, fixed using formaldehyde 1% for 2 h, and sent to the ANIPATH platform (Lyon) for inclusion, section and H&E staining.

Soft-agar colony formation To evaluate the transformation of cells, soft-agar colony formation assays were performed as follows. The bottom agar layer was prepared from 1.5% agar (Promega) diluted in an equal volume of 2× culture medium to a final concentration of 0.75%, added to cell culture plates and incubated at room temperature for 30 min. The top agar layer was prepared accordingly at a final density of 0.45%. Cells were mixed into the liquid top agar and added on top of the bottom agar at a final concentration of 10,000 cells/ml. Cell culture plates were incubated at room temperature for 30 min and covered with medium. Colonies were quantified and measured after 15 to 21 days of culture at 5% CO2 and 37° C.

Retroviral Production and Infection

The CMV-BMP2-mPGK-hygromycin lentiviral vector construct and its corresponding control were a gift from Dr R. Iggo, University of Bordeaux, France. The pLenti X2 Puro empty control vector (#20957) and the pLenti X2 puro DEST (#17296) used to clone the pX2-shBMPR1B vector were purchased from Addgene (Campeau et al, 2009). Lentiviruses were produced by calcium phosphate co-transfection of lentiviral constructs with a VSV-G envelope construct (pMD2.G) and gagpol packaging construct (PCMVdR8.74) into HEK 293T cells according to standard techniques (Dull et al., 1998; Follenzi and Naldini, 2002). Six hours post transfection the medium was replaced. Lentiviral particles were collected 48 h post transfection. Lentiviral titers were determined for each viral batch by serial dilution infections of MCF10A cells and subsequent puromycin or hygromycin (both Sigma-Aldrich) treatment. MCF10A cells were seeded one day prior to infection and cells were infected overnight at a multiplicity of infection of 5-10. Forty-eight hours post infection, transduced cells were selected by puromycin or hygromycin B treatment for 96 hours to two weeks.

Quantitative RT qPCR

RNA was extracted by using RNeasy Plus Mini Kits (Qiagen) containing a gDNA eliminator column or TriReagent (Sigma-Aldrich) and chloroform extraction using Phase Lock Gel columns (5Prime, Hilden, Germany). RNA concentration was measured by Nanodrop ND-1000 spectrophotometer. Reverse transcription was conducted using Superscript II (Invitrogen) according to the manufacturer's instructions. cDNA was stored at −80° C. Quantitative PCR (qPCR) was performed using sequence-specific primers on a LightCycler 480 II system (Roche Applied Science, Indianapolis) with SyBR Green I technology (QuantiFAST SyBR kit from Qiagen) and LightCycler 480 Multiwell Plate 96 (Roche Applied Science). CPB and ACTB1 were selected by geNorm analysis as reference genes.

Western Blot Analysis

Cells were lysed in RIPA buffer (50 mM Tris, pH 7.4, 150 mM, NaCl, 5 mM EDTA, pH 8.0, 30 mM NaF, 1 mM Na3VO4, 40 mM β-glycerophosphate, protease inhibitors cocktail, Roche). Whole cell extracts were fractionated by SDS-PAGE and transferred onto a polyvinylidene-di-fluoride membrane using a transfer apparatus according to the manufacturer's protocols (Bio-Rad Trans Blot Turbo). After incubation with 5% nonfat milk in TBST (10 mM Tris, pH 8.0, 150 mM NaCl, 0.5% Tween 20) for 30 min, the membrane was washed once with TBST and incubated with antibodies, as detailed in the following table, at 4° C. for 12 h. Membranes were washed three times for 10 min and incubated with a 1:25000 dilution of horseradish peroxidase-conjugated anti-mouse or anti-rabbit antibodies (Jackson Research) for 45 min. Blots were washed with TBST three times and developed with the ECL system (Roche Lumi-Light Plus) according to the manufacturer's protocols.

TABLE 3

| Antibody | Supplier | Reference | Dilution |
|----------|----------|-----------|----------|
| CD10 | Abcam | EP2998 | 1/500 |
| GAPDH | Cell Signaling | D16H11 | 1/25000 |

Flow Cytometry and Cell Sorting

Cells were resuspended in PBS and incubated for 30 min to 1 h with 8 μL of the following antibodies per 106 cells: PE-conjugated anti-CD10 (BD Biosciences). After centrifugation, cells were resuspended in HBSS, 2% FBS for flow cytometry cell sorting at a concentration of 5-10×106 cells/ml. Cell sorting was performed using a FACS Aria cell sorter (BD Biosciences) at low pressure (psi: 20) with 488 nm and 633 nm lasers. For phenotypic analysis, cells were suspended in PBS 1× and incubated for 30 min to 1 h with 1 μL PE-conjugated anti-CD10 antibody (BD Biosciences) (or isotype PE-conjugated IgG1). Flow cytometry analysis was performed using a FACSCalibur cell analyzer (BD Biosciences).

Microarray Analysis

Microarray analysis was done by the platform ProfileXpert (SFR Santé Lyon-Est UCBL-UMS 3453 CNRS—US7 INSERM) according to the following protocol: Microarray analysis was performed using a high-density oligonucleotide array (GeneChip Human Genome U133 plus 2.0 array, Affymetrix). Total RNA (50 ng) was amplified and biotin-labeled using GeneChip®3' IVT PLUS kit. Before amplification, spikes of synthetic mRNA at different concentrations were added to all samples; these positive controls were used to ascertain the quality of the process. Biotinylated antisense cRNA for microarray hybridization was prepared. After final purification using magnetic beads, cRNA quantification was performed with a nanodrop and quality checked with Agilent 2100 Bioanalyzer (Agilent technologies, Inc, Palto Alto, CA, USA). Hybridization was performed following Affymetrix protocol. Briefly, 10 μg of labeled cRNA was fragmented and denaturated in hybridization buffer, then hybridized on chip during 16 hours at 45° C. with constant mixing by rotation at 60 rpm in an Genechip hybridization oven 640 (Affymetrix). After hybridization, arrays were washed and stained with streptavidin-phycoerythrin (GeneChip® Hybridization Wash and Stain Kit) in a fluidic 450 (Affymetrix) according to the manufacturer's instruction. The arrays were read with a confocal laser (Genechip scanner 3000, Affymetrix). Then CEL files were generated using the Affymetrix GeneChip Command Console (AGCC) software 3.0. The obtained data were normalized with Affymetrix Expression Console software using MAS5 statistical algorithm.

Identification of the genes composing the CD10 signature was done using the GenePattern modules. Briefly, CEL files were converted to RES files using the "ExpressionFileCreator module", log 2 transformed using the "PreprocessDataset" module and different probe sets values for a gene were converted to a single value by the "CollapseDataset" module using the "maximum" collapse mode. Differentially expressed genes between CD10$^-$ and CD10$^+$ MCF10A-CT cells were then identified using the "ComparativeMarkerSelection" module. Transcriptomic data were deposited on the GEO portal under the accession number GSE123053 and are currently not publicly released.

Public Datasets

The TCGA RNA data were obtained from the GDC data portal available at portal.gdc.cancer.gov/. Curated clinical data were obtained from Table 1 of the TCGA-CDR paper. Following the author's recommendations, the inventors used PFI (Progression-free interval) as the outcome endpoint for survival analysis excepted for LAML cancers for which overall survival was used. PAM50 breast cancer subtypes for the TCGA-BRCA samples were obtained from additional file 2 of the following paper64, where the normal-like samples were removed since this subtype is likely to be an artifact caused by normal cells contamination of the tumor65.

Bioinformatics Analysis

Data analysis was performed using the Array Studio software (Omicsoft Corporation) and the Bioconductor packages in the R language (www.bioconductor.org). Raw data from microarrays were processed using quantile normalization and the robust multi-array average (RMA) algorithm and were log 2 transformed.

GSEA was performed using the "pre-ranked" tool. GSEA is a robust computational method that determines whether a pre-defined set of genes shows statistically significant differences between 2 biological states (in our case tumor versus normal). GSEA aims to interpret large-scale expression data by identifying pathways and processes. The input data for GSEA procedure were the following: i-a complete table of genes ranked according to the log 2 transformed FC between two groups of samples, ii-a mapping file for identifying transcripts in the corresponding platform; and iii-a catalogue of functional gene sets from Molecular signature Database. Default parameters were used. Inclusion gene set size was set between 15 and 500 and the phenotype was permutated 1,000 times.

The single-sample GSEA (ssGSEA) projection tool from GenePattern was used to compute separate enrichment scores (ES) for each sample of a given dataset using the CD10 signature. The gene expression values for a given sample are rank-normalized, and an ES is produced using the empirical cumulative distribution functions of the genes included in the signature and the remaining genes.

Statistical Analysis

Data from the different MCF10A-cell derived models were compared using the paired Student t-test, when data were normally distributed, or the Wilcoxon signed-rank test when data were not normally distributed. Unpaired Student t-test or Mann-Whitney test were performed to compare continuous data between two groups and one-way ANOVA or Kruskal-Wallis test if more than 2 groups. Pearson's X2 test or Fisher's exact test were used to analyze qualitative data.

Overall survival (OS) as well as Progression-free survival curves were estimated using the Kaplan-Meier method and compared with the Log-Rank test between groups of patients defined by median of the signature enrichment scores (low vs high score). For TCGA data analysis, the effect of the CD10-score on survival outcomes were estimated, for each cancer separately, by Hazard Ratios corresponding to one standard deviation of the CD10-score taken as a continuous variable in the Cox model. In order to obtain an "overall pancancer" estimate of the effect of the CD10-score, unadjusted and multivariable Cox models were fitted with a strata term on cancer type (i.e., each tumor type had a specific baseline hazard function) so that variations in survival between the different cancers were taken into account and treated as a "nuisance parameter". For this pancancer analysis, the CD10-score was discretized with deciles, to being able to finely investigate a putative dose-response relationship of the effect of the CD10-score on survival outcome. To compare the CD10-score levels in tumor and normal paired samples, the Wilcoxon signed rank test was used.

All statistical tests were two-sided, and P-values<0.05 were considered to be statistically significant.

The statistical analysis was performed using GraphPad Prism version 6.00 (San Diego, SA) and Bioconductor packages in the R language.

Results

BMP2-transformed MCF10A cells are comparable to early luminal breast cancer and constitute a new element in a progressive transformation model.

Figure 1:
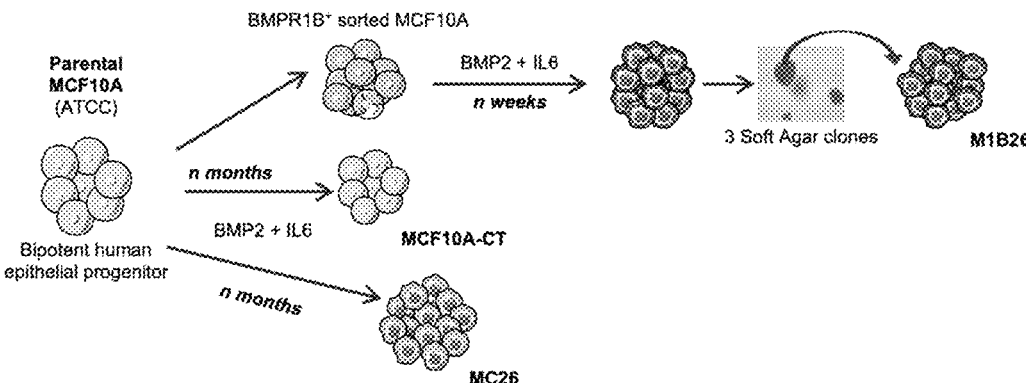
FIG. 1 represents the experimental procedure to generate new breast cancer models from parental MCF10A by chronic exposure to BMP2 (10 ng/ml) and IL6 (10 ng/ml) (MC26) or following BMPR1B-positive cell sorting and soft-agar assay (M1B26), compared to untreated long-term cultured MCF10A cells (CT).
Figure 2:
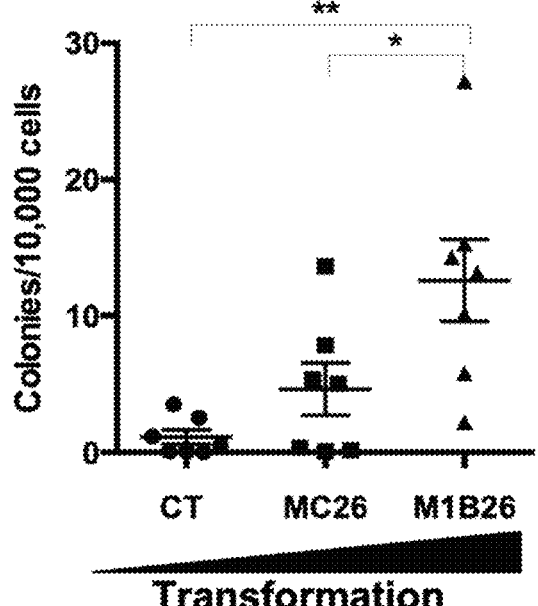
FIG. 2 represents the comparison between the different levels of transformation of MCF10A-derived cells by quantification of soft-agar colony formation. Error bars represent the SEM (n=7). Significance was measured using the Mann-Whitney test. $*P<0.05$; $**P<0.01$.
Figure 3:
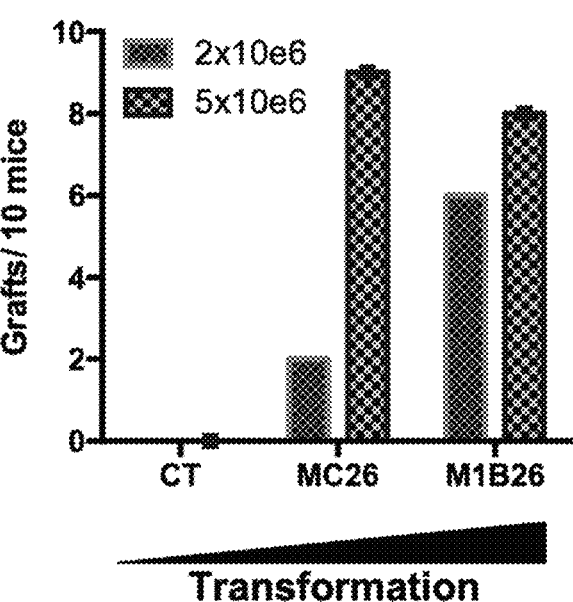
FIG. 3 represents a graph showing the Xenografts of the indicated number of MCF10A cell-models injected in nude mice following long-term exposure to BMP2/IL6. Data represent the number of successful grafts after 4 weeks per mouse (n=10).

To understand the role of CD10 in the first steps of breast cancer development, the inventors generated an extended model of breast cancer combining (i) a recently developed in-house cell line (MC26) with properties comparable to early stages of luminal breast cancer17 and (ii) a new MCF10A-derived cell line (M1B26) representative of early progression steps of transformation (FIG. 1). These models are based on the MCF10A cell line, which is derived from a non-malignant fibrocystic mammary tissue, is characterized by a p16/CDKN2A gene deletion and a c-Myc gene amplification, and constitutes a powerful model of immature mammary epithelial cells primed for transformation. Sorted BMPRIB+MCF10A cells transformed by long term-exposure to BMP2 and IL6 allowed to isolate the M1B26 cell line. This was achieved by harvesting three soft-agar clones from these BMP2/IL-6 treated BMPR1B+MCF10A cells that were further expanded in presence of constant BMP2/IL-6 treatment (FIG. 1). The relative level of transformation of the different MCF10A-derived models were then assessed using soft-agar colony formation assays and showed an increased ability of MC26 and M1B26 cells to form anchorage-independent clones in soft-agar, compared to untreated control cells (CT) (FIG. 2). The inventors performed engraftment assays in immunocompromised mice to further validate the transformation status of MC26 and M1B26 models. These confirmed that both MC26 and M1B26 were able to engraft in mice, though M1B26 cells displayed a higher level of engraftment (FIG. 3). Next, a transcriptomic analysis using Affymetrix U133 Plus 2.0 Arrays was performed on CT, MC26 and M1B26 cell lines. The inventors applied a GSEA analysis on the genes differentially expressed between MC26, M1B26 and parental MCF10A-CT cells using the Hallmarks gene sets from the MSigDB (FIG. 4). Among the pathways enriched in both MC26 and M1B26, the IL6 and TGF3 signaling are likely related to the BMP2/IL6 treatment used to derive MC26 and M1B26 from MCF10A cells and validate the interest of this GSEA analysis. Among deregulated pathways, it is interesting to note that several signaling pathways are affected. Genes involved in interferon alpha and gamma response, in TNF alpha signaling and genes upregulated following KRAS signaling are upregulated in MC26 and M1B26 cells compared to MCF10A-CT cells. On the other hand, c-myc and E2F targets are down-regulated in MC26 and M1B26 as well as numerous genes involved in estrogen response. In addition, genes involved in oxidative phosphorylation are also downregulated in the transformed cell lines and genes involved in glycolysis upregulated in M1B26, reminiscent of a Warburg effect. Finally, genes involved in the epithelial to mesenchymal transition are also upregulated in the most transformed M1B26 cell line. A complete Gene Ontology (GO) enrichment analysis comparing MC26 and M1B26 cells to MCF10A-CT cells is shown in Table 4.

Table 4: GO term enrichment analysis comparing MC26 and M1B26 to MCF10A-CT cells

TABLE 4

| GO term enrichment analysis comparing MC26 and M1B26 to MCF10A-CT cells | | | | | |
| --- | --- | --- | --- | --- | --- |
| MC26 GO term | P-value | M1B26 GO term | p-value | MC26/M1B26 GO term | Colonne 3 p-value |
| developmental process (GO:0032502) | 5.68E−08 | DNA replication (GO:0006260) | 2.65E−07 | multicellular organismal process (GO:0032501) | 1.22E−08 |
| multicellular organism development (GO:0007275) | 1.62E−07 | negative regulation of cellular process (GO:0048523) | 7.24E−07 | developmental process (GO:0032502) | 2.67E−08 |
| tissue development (GO:0009888) | 1.70E−07 | cell cycle G1/S phase transition (GO:0044843) | 7.89E−07 | multicellular organism development (GO:0007275) | 6.75E−08 |
| anatomical structure development (GO:0048856) | 1.76E−07 | response to stimulus (GO:0050896) | 8.80E−07 | anatomical structure development (GO:0048856) | 7.18E−08 |
| regulation of developmental process (GO:0050793) | 2.32E−07 | G1/S transition of mitotic cell cycle (GO:0000082) | 8.87E−07 | regulation of signaling (GO:0023051) | 1.03E−07 |
| anatomical structure morphogenesis (GO:0009653) | 2.37E−07 | response to stress (GO:0006950) | 8.88E−07 | regulation of cell communication (GO:0010646) | 1.07E−07 |
| regulation of cell proliferation (GO:0042127) | 6.79E−07 | mitotic cell cycle phase transition (GO:0044772) | 1.05E−06 | regulation of response to stimulus (GO:0048583) | 1.15E−07 |
| system development (GO:0048731) | 1.10E−06 | DNA-dependent DNA replication (GO:0006261) | 1.18E−06 | response to organic substance (GO:0010033) | 2.16E−07 |
| negative regulation of biological process (GO:0048519) | 1.17E−05 | anatomical structure development (GO:0048856) | 1.27E−06 | regulation of signal transduction (GO:0009966) | 3.07E−07 |
| negative regulation of cell proliferation (GO:0008285) | 1.64E−05 | system development (GO:0048731) | 1.37E−06 | system development (GO:0048731) | 3.29E−07 |
| regulation of multicellular organismal development (GO:2000026) | 6.30E−05 | negative regulation of biological process (GO:0048519) | 1.45E−06 | regulation of multicellular organismal process (GO:0051239) | 9.94E−07 |
| negative regulation of cellular process (GO:0048523) | 6.39E−05 | multicellular organism development (GO:0007275) | 1.49E−06 | response to wounding (GO:0009611) | 2.63E−06 |
| cellular developmental process (GO:0048869) | 9.14E−05 | cell cycle phase transition (GO:0044770) | 1.54E−06 | negative regulation of cellular process (GO:0048523) | 6.92E−06 |
| regulation of multicellular organismal process (GO:0051239) | 9.50E−05 | cellular response to chemical stimulus (GO:0070887) | 2.56E−06 | regulation of anatomical structure morphogenesis (GO:0022603) | 7.03E−06 |
| epithelium development (GO:0060429) | 9.59E−05 | response to organic substance (GO:0010033) | 2.92E−06 | regulation of proteolysis (GO:0030162) | 7.11E−06 |
| cell differentiation (GO:0030154) | 9.85E−05 | developmental process (GO:0032502) | 4.80E−06 | positive regulation of biological process (GO:0048518) | 7.18E−06 |
| multicellular organismal process (GO:0032501) | 1.27E−04 | blood vessel morphogenesis (GO:0048514) | 5.02E−06 | Unclassified (UNCLASSIFIED) | 1.36E−05 |

TABLE 4-continued

GO term enrichment analysis comparing MC26 and M1B26 to MCF10A-CT cells

| MC26 GO term | P-value | M1B26 GO term | p-value | MC26/M1B26 GO term | Colonne 3 p-value |
|---|---|---|---|---|---|
| animal organ development (GO:0048513) | 1.28E−04 | angiogenesis (GO:0001525) | 8.77E−06 | biological process (GO:0008150) | 1.44E−05 |
| extracellular matrix organization (GO:0030198) | 2.23E−04 | response to chemical (GO:0042221) | 9.27E−06 | regulation of biological quality (GO:0065008) | 1.51E−05 |
| response to stress (GO:0006950) | 2.34E−04 | cellular response to organic substance (GO:0071310) | 9.97E−06 | response to chemical (GO:0042221) | 2.74E−05 |
| biological regulation (GO:0065007) | 2.77E−04 | DNA replication initiation (GO:0006270) | 1.17E−05 | regulation of multicellular organismal development (GO:2000026) | 3.48E−05 |
| regulation of biological process (GO:0050789) | 3.18E−04 | response to cytokine (GO:0034097) | 1.69E−05 | tissue development (GO:0009888) | 3.65E−05 |
| extracellular structure organization (GO:0043062) | 3.25E−04 | biological regulation (GO:0065007) | 2.35E−05 | wound healing (GO:0042060) | 4.41E−05 |
| cellular process (GO:0009987) | 4.04E−04 | cellular process (GO:0009987) | 3.98E−05 | negative regulation of biological process (GO:0048519) | 5.12E−05 |
| regulation of cellular process (GO:0050794) | 6.00E−04 | positive regulation of multicellular organismal process (GO:0051240) | 4.12E−05 | tube morphogenesis (GO:0035239) | 5.44E−05 |
| regulation of cellular component biogenesis (GO:0044087) | 8.29E−04 | anatomical structure formation involved in morphogenesis (GO:0048646) | 4.13E−05 | regulation of developmental process (GO:0050793) | 5.55E−05 |
| regulation of cell adhesion (GO:0030155) | 8.30E−04 | anatomical structure morphogenesis (GO:0009653) | 4.50E−05 | secretion by cell (GO:0032940) | 5.93E−05 |
| regulation of cellular component organization (GO:0051128) | 8.76E−04 | positive regulation of angiogenesis (GO:0045766) | 4.56E−05 | regulation of vasculature development (GO:1901342) | 6.42E−05 |
| positive regulation of biological process (GO:0048518) | 9.40E−04 | positive regulation of developmental process (GO:0051094) | 6.33E−05 | biological regulation (GO:0065007) | 7.21E−05 |
| positive regulation of cellular process (GO:0048522) | 9.68E−04 | tube morphogenesis (GO:0035239) | 6.91E−05 | anatomical structure formation involved in morphogenesis (GO:0048646) | 9.70E−05 |
| | | tube development (GO:0035295) | 8.07E−05 | regulation of cell differentiation (GO:0045595) | 9.80E−05 |
| | | response to external stimulus (GO:0009605) | 8.08E−05 | cellular response to chemical stimulus (GO:0070887) | 1.01E−04 |
| | | blood vessel development (GO:0001568) | 8.12E−05 | positive regulation of cellular process (GO:0048522) | 1.34E−04 |
| | | multicellular organismal process | 8.22E−05 | cellular developmental process | 1.36E−04 |

TABLE 4-continued

| GO term enrichment analysis comparing MC26 and M1B26 to MCF10A-CT cells | | | | | |
|---|---|---|---|---|---|
| MC26 GO term | P-value | M1B26 GO term | p-value | MC26/M1B26 GO term | Colonne 3 p-value |
| | | (GO:0032501) positive regulation of vasculature development (GO:1904018) | 1.10E−04 | (GO:0048869) regulation of cell proliferation (GO:0042127) | 1.48E−04 |
| | | regulation of response to stimulus (GO:0048583) | 1.13E−04 | positive regulation of signal transduction (GO:0009967) | 1.54E−04 |
| | | vasculature development (GO:0001944) | 1.64E−04 | negative regulation of multicellular organismal process (GO:0051241) | 1.55E−04 |
| | | response to abiotic stimulus (GO:0009628) | 1.77E−04 | positive regulation of cell communication (GO:0010647) | 1.56E−04 |
| | | regulation of localization (GO:0032879) | 1.79E−04 | cell differentiation (GO:0030154) | 1.56E−04 |
| | | regulation of locomotion (GO:0040012) | 2.00E−04 | blood vessel development (GO:0001568) | 1.58E−04 |
| | | cardiovascular system development (GO:0072358) | 2.01E−04 | positive regulation of signaling (GO:0023056) | 1.63E−04 |
| | | mitotic cell cycle process (GO:1903047) | 2.01E−04 | positive regulation of apoptotic process (GO:0043065) | 1.69E−04 |
| | | DNA metabolic process (GO:0006259) | 2.07E−04 | angiogenesis (GO:0001525) | 1.71E−04 |
| | | positive regulation of cellular process (GO:0048522) | 2.40E−04 | positive regulation of programmed cell death (GO:0043068) | 1.85E−04 |
| | | regulation of cell migration (GO:0030334) | 2.41E−04 | regulation of cell migration (GO:0030334) | 1.85E−04 |
| | | cellular response to cytokine stimulus (GO:0071345) | 2.71E−04 | response to oxygen-containing compound (GO:1901700) | 1.86E−04 |
| | | regulation of catalytic activity (GO:0050790) | 2.72E−04 | regulation of cellular component movement (GO:0051270) | 1.87E−04 |
| | | regulation of cell motility (GO:2000145) | 2.73E−04 | epithelium development (GO:0060429) | 1.88E−04 |
| | | animal organ development (GO:0048513) | 2.75E−04 | secretion (GO:0046903) | 2.00E−04 |
| | | immune system process (GO:0002376) | 3.16E−04 | regulation of protein metabolic process (GO:0051246) | 2.02E−04 |
| | | circulatory system development (GO:0072359) | 3.19E−04 | regulation of biological process (GO:0050789) | 2.02E−04 |
| | | regulation of molecular function (GO:0065009) | 3.27E−04 | regulation of angiogenesis (GO:0045765) | 2.04E−04 |
| | | cellular response to oxygen- | 3.59E−04 | response to stimulus | 2.24E−04 |

TABLE 4-continued

| GO term enrichment analysis comparing MC26 and M1B26 to MCF10A-CT cells | | | | | |
|---|---|---|---|---|---|
| MC26 GO term | P-value | M1B26 GO term | p-value | MC26/M1B26 GO term | Colonne 3 p-value |
| | | containing compound (GO:1901701) | | (GO:0050896) | |
| | | positive regulation of inflammatory response (GO:0050729) | 4.40E−04 | positive regulation of multicellular organismal process (GO:0051240) | 2.29E−04 |
| | | cellular response to stimulus (GO:0051716) | 4.47E−04 | negative regulation of protein metabolic process (GO:0051248) | 2.32E−04 |
| | | regulation of cell proliferation (GO:0042127) | 4.93E−04 | vasculature development (GO:0001944) | 2.35E−04 |
| | | regulation of cellular component movement (GO:0051270) | 4.98E−04 | blood vessel morphogenesis (GO:0048514) | 2.38E−04 |
| | | regulation of developmental process (GO:0050793) | 5.07E−04 | regulation of cellular protein metabolic process (GO:0032268) | 2.65E−04 |
| | | cell proliferation (GO:0008283) | 5.44E−04 | cellular response to organic substance (GO:0071310) | 2.75E−04 |
| | | cell cycle process (GO:0022402) | 5.57E−04 | negative regulation of cellular protein metabolic process (GO:0032269) | 2.80E−04 |
| | | biological process (GO:0008150) | 5.70E−04 | cardiovascular system development (GO:0072358) | 2.88E−04 |
| | | Unclassified (UNCLASSIFIED) | 5.79E−04 | tube development (GO:0035295) | 3.16E−04 |
| | | positive regulation of biological process (GO:0048518) | 6.36E−04 | regulation of cellular process (GO:0050794) | 4.36E−04 |
| | | regulation of cellular process (GO:0050794) | 6.51E−04 | regulation of cell motility (GO:2000145) | 4.72E−04 |
| | | cell migration (GO:0016477) | 6.76E−04 | anatomical structure morphogenesis (GO:0009653) | 5.01E−04 |
| | | organic substance biosynthetic process (GO:1901576) | 7.14E−04 | positive regulation of cell differentiation (GO:0045597) | 5.17E−04 |
| | | regulation of biological process (GO:0050789) | 7.41E−04 | positive regulation of cell death (GO:0010942) | 5.36E−04 |
| | | biosynthetic process (GO:0009058) | 7.50E−04 | regulation of cellular component organization (GO:0051128) | 5.36E−04 |
| | | leukocyte activation (GO:0045321) | 7.84E−04 | regulation of molecular function (GO:0065009) | 6.49E−04 |
| | | regulation of multicellular organismal | 7.87E−04 | response to molecule of bacterial origin | 7.00E−04 |

TABLE 4-continued

GO term enrichment analysis comparing MC26 and M1B26 to MCF10A-CT cells

| MC26 GO term | P-value | M1B26 GO term | p-value | MC26/M1B26 GO term | Colonne 3 p-value |
|---|---|---|---|---|---|
| | | process (GO:0051239) | | (GO:0002237) | |
| | | cytokine-mediated signaling pathway (GO:0019221) | 7.92E−04 | regulation of cell death (GO:0010941) | 7.02E−04 |
| | | positive regulation of defense response (GO:0031349) | 8.94E−04 | positive regulation of developmental process (GO:0051094) | 7.63E−04 |
| | | response to oxygen-containing compound (GO:1901700) | 9.29E−04 | regulation of locomotion (GO:0040012) | 7.91E−04 |
| | | cell motility (GO:0048870) | 9.45E−04 | regulation of apoptotic process (GO:0042981) | 8.45E−04 |
| | | response to endogenous stimulus (GO:0009719) | 9.52E−04 | positive regulation of response to stimulus (GO:0048584) | 8.54E−04 |
| | | localization of cell (GO:0051674) | 9.58E−04 | response to peptide (GO:1901652) | 9.29E−04 |
| | | cellular developmental process (GO:0048869) | 9.64E−04 | cell death (GO:0008219) | 9.60E−04 |
| | | | | regulation of localization (GO:0032879) | 9.63E−04 |

Figure 6:
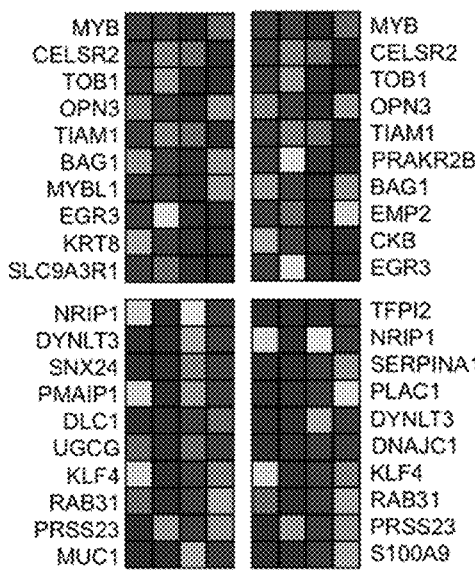
FIG. 6 represents the Heat maps showing the top 20 differentially expressed early (left panel) and late (right panel) stage estrogen-responsive genes in MCF10A-CT and MC26 cells (n=4).

Importantly, the inventors observed that the transcriptomic changes described in the literature, when comparing breast carcinoma to healthy breast tissues, were replicated by MC26 and M1B26 cells compared to their non-transformed CT counterparts. Indeed, when comparing our data with those obtained from breast ductal carcinoma or normal breast tissue using the same Affymetrix array, the inventors observed that both C26 and M1B26 present a highly similar molecular expression profile to that of primary breast cancer cells for both up- or down-regulated genes (FIG. 5). Consistently, MCF10A-CT cells displayed a molecular profile resembling normal breast tissue. Lastly, the inventors observed a change in the expression profile of estrogen responsive genes for both early and late estrogen-related signaling pathways (FIG. 6). This indicates that BMP2-mediated MCF10A transformation is accompanied by a modulation of the estrogen pathway. Collectively, these data establish that the BMP2-transformed MCF10A-CT, MC26 and M1B26 cell lines constitute a unique model of progressive transformation to study transformation events in breast epithelial cells arising from an immature epithelial cell.

Figure 7:
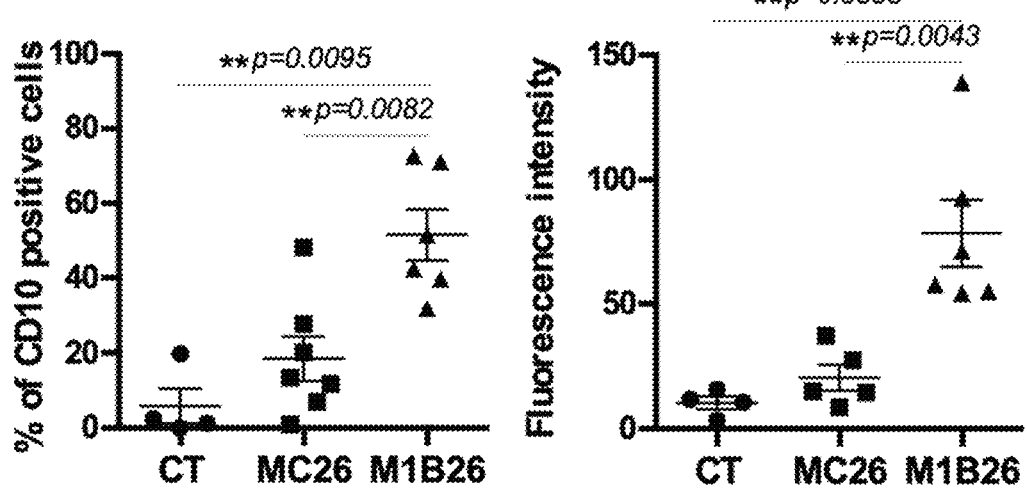
FIG. 7 represents graphs showing that CD10 expression is correlated with immature and transformed features. Flow cytometry analysis of CD10 expression of MCF10A-CT (n=4), MC26 (n=7) and M1B26 (n=6) presented as the percentage of positive cells (left panel) and the mean fluorescence intensity (right panel).
Figure 8:
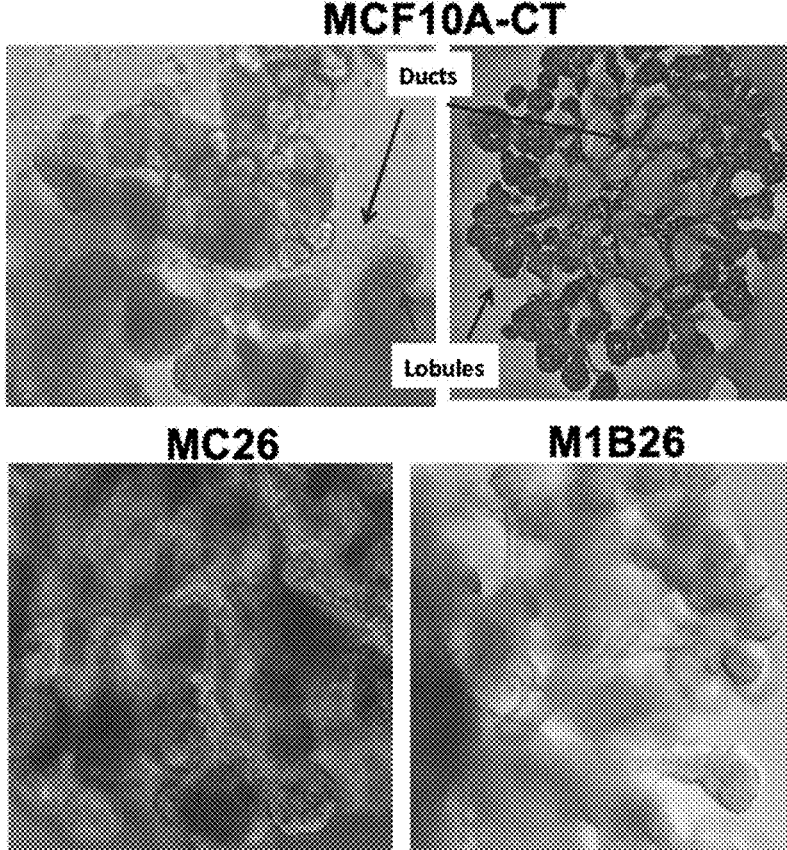
FIG. 8 represents bright field images at day 21 of 3D structures in the TDLU assay from MCF10A-CT, MC26 or M1B26 cells. A representative TDLU section from MCF10A-CT cells, stained with H&E, is shown on the upper right panel in addition to the bright field image.
Figure 9:
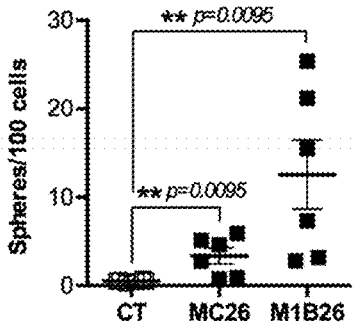
FIG. 9 represents a graph showing number of spheres per initial 100 seeded cells generated following one week of culture from MCF10A CT (n=4), MC26 (n=6) and M1B26 (n=6) models.
Figure 10:
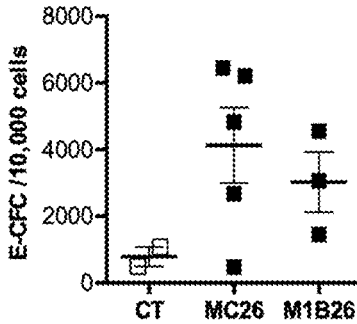
FIG. 10 represents a graph showing progenitor content from MCF10A-CT (n=2), MC26 (n=5) or M1B26 (n=3) was quantified using the E-CFC assay and represent the colonies number scored after 6 days per 10,000 seeded cells.

CD10 expression is linked to immature cell properties and increases with cell transformation The inventors and others previously reported that CD10 expression was correlated with a mammary stem cell fraction in human primary mammary glands. The inventors thus evaluated the CD10 cell membrane expression by flow cytometry analysis and observed a higher proportion of positive cells in MC26 (18,5%) and M1B26 (51,6%) models compared to CT (5,9%) cells (FIG. 7). In addition, higher mean fluorescence intensity indicated that CD10-positive transformed cells also displayed more CD10 molecules per cell than their non-transformed counterparts (FIG. 7). As MCF10A cells display immature properties similar to primary human mammary cells, the inventors assessed the ability of MC26 and M1B26 to generate spheres, epithelial-colonies (E-CFC), and terminal ductal-lobular complex structures (TDLU). Similarly to parental MCF10A cells both MC26 and M1B26 models produced TDLU structures in 3D-TDLU assays, indicating that the transformed cells retained their immature properties (FIG. 8), as further confirmed by the higher frequency of MC26 and M1B26 cells with sphere-forming ability compared to CT cells (FIG. 9). Likewise the inventors detected more epithelial-colonies (E-CFC) within MC26 and M1B26 cell models (FIG. 10).

Figure 11:
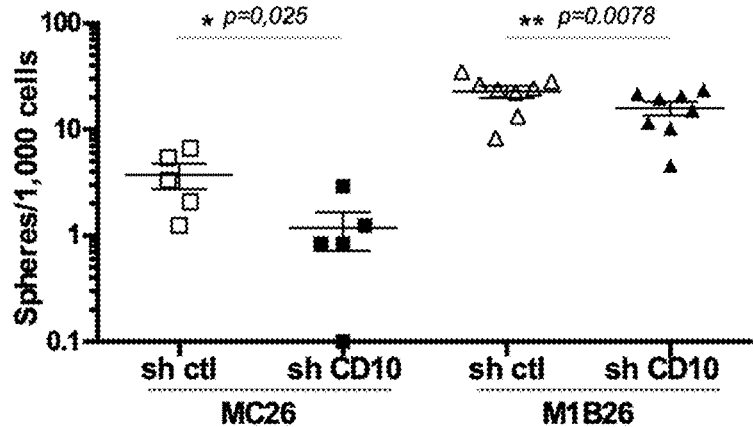
FIG. 11 represents a graph showing that sphere-forming ability was evaluated by counting spheres per initial 100 seeded cells after 1 week for MC26 (n=6) or M1B26 (n=8) cells infected with lentiviruses carrying a scramble control (sh ctl) or specific shCD10 vector.
Figure 46:
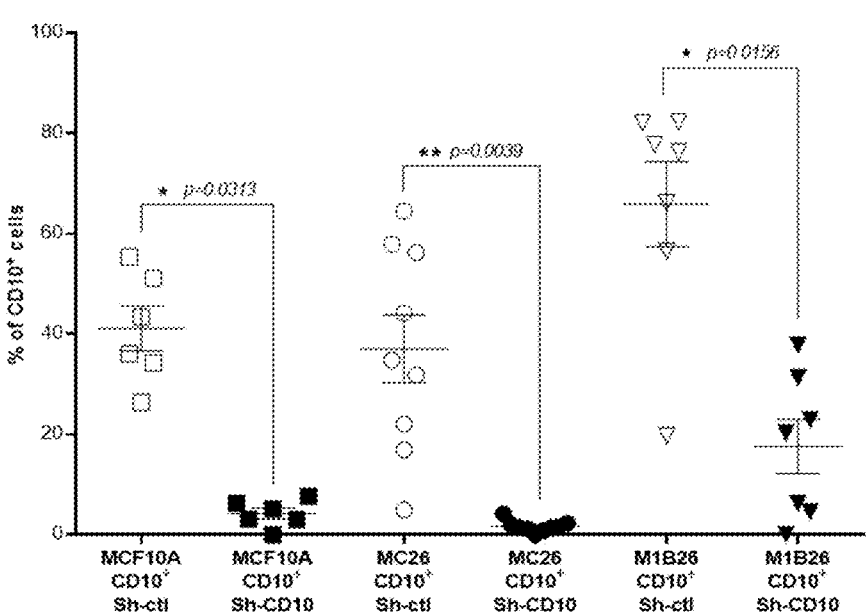
FIG. 46 FACS sorted CD10$^+$ MCF10A-CT (squares), MC26 (circles) or M1B26 (triangles) cells were transduced with a lentiviral vector expression a shRNA targeting CD10 (sh-CD10, black symbols) or a control shRNA (sh-ctl, open symbols). CD10 membrane expression was then measured by flow-cytometry and results shown as percentage of CD10$^+$ cells.

To verify whether these stem cell features arose from the expression of CD10, the inventors sorted CD10+ cells and repressed its expression using RNA interference strategies (shCD10) (FIG. 46) prior to conducting sphere-forming or E-CFC assays. Impairing CD10 expression significantly reduced the number of cell-forming spheres in MC26 (FIG. 11).

Figure 12:
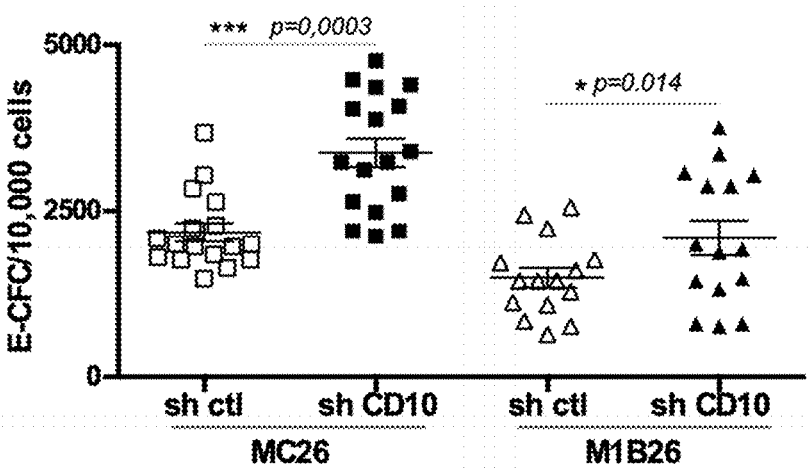
FIG. 12 represents progenitors content from lentiviral-infected MC26 cells (n=17) or M1B26 cells (n=15) seeded at 250 cells/well after one week.
Figure 13:
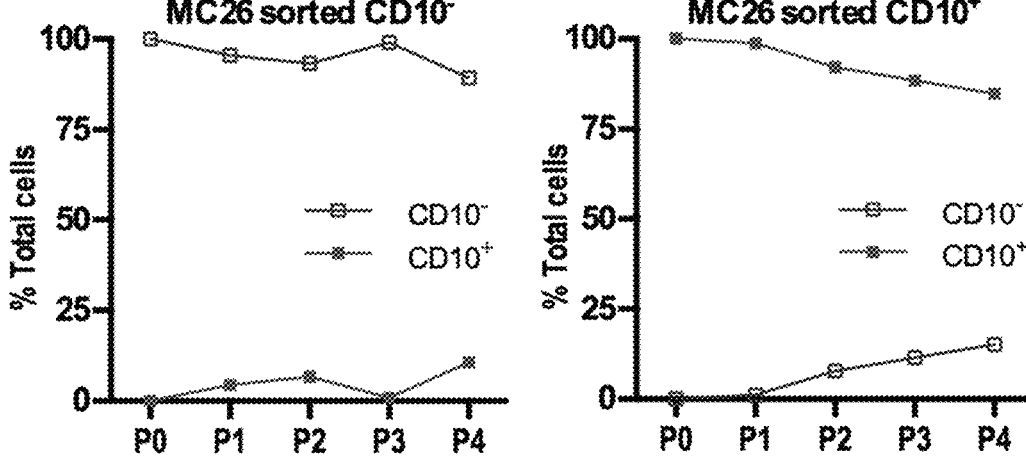
FIG. 13 MC26 were sorted according to their CD10 cell membrane status and its expression was monitored by flow cytometry at each subsequent passage. Data obtained from the CD10$^-$ (left panel) or CD10$^+$ (right panel) sub-fraction represent the percentage of CD10-expressing cells (red line) or CD10-negative cells (blue line).
Figure 14:
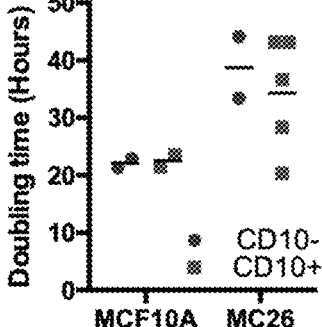
FIG. 14 Doubling time of CD10$^-$ or CD10$^+$ sorted from MCF10A-CT (n=2) or MC26 (n=2 or 5, respectively) was monitored by trypan blue.
Figure 15:
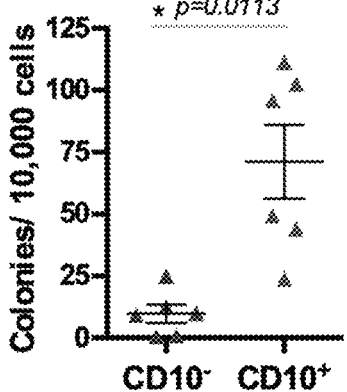
FIG. 15 Soft-agar assay with CD10$^-$ or CD10$^+$ sorted cells from MC26 (n=6).
Figure 16:
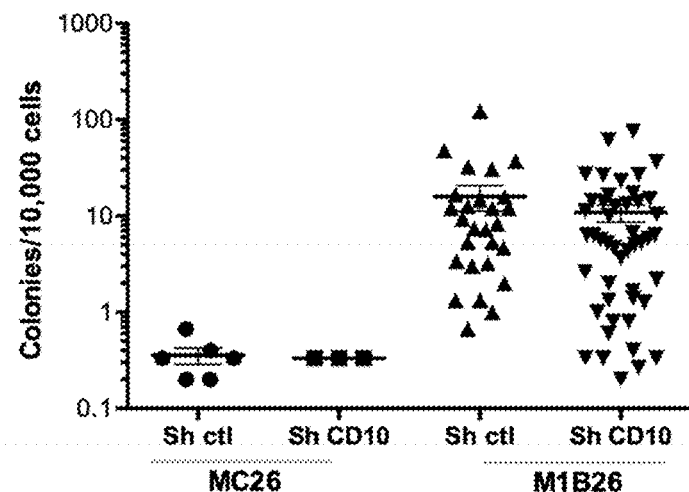
FIG. 16 represents Soft-agar assay in CD10-positive MC26- or M1B26-expressing scramble control (sh ctl) or shCD10 vector.
Figure 17:
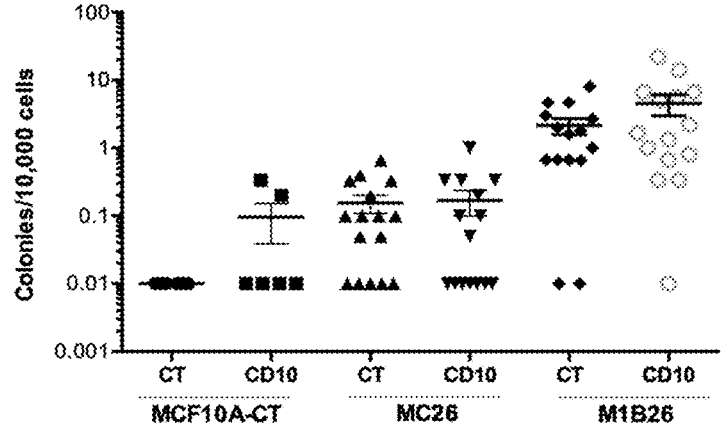
FIG. 17 represents Soft-agar assay in CD10-negative MCF10A-CT, MC26- or M1B26-expressing an empty control (CT) or CD10 expression vector (CD10).
Figure 47:
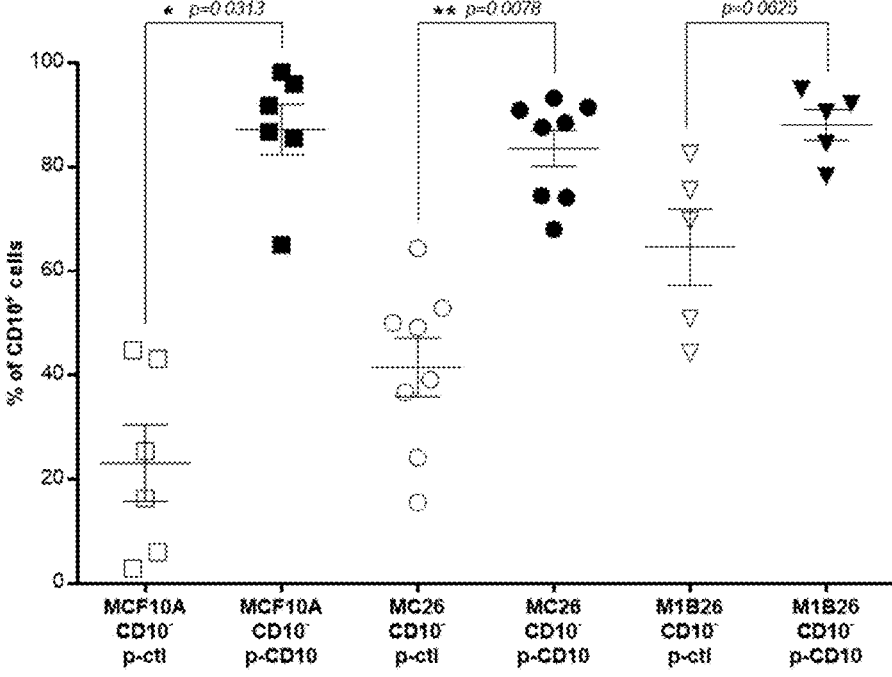
FIG. 47 FACS sorted CD10$^-$ MCF10A-CT (squares), MC26 (circles) or M1B26 (triangles) cells were transduced with a lentiviral CD10 expression vector (p-CD10, black symbols) or a control, empty vector (p-ctl, open symbols). CD10 membrane expression was then measured by flow-cytometry and results shown as percentage of CD10$^+$ cells FIG. 48 CD10 mRNA expression in breast tumor sub-types in the METABRIC cohort FIG. 49 Kaplan-Meier plots of breast cancers patients survival from the TCGA cohort.

Conversely, shutting down CD10 resulted in a significant increase in epithelial-colony (E-CFC) production in both MC26 and M1B26 models (FIG. 12). These data indicate that, as demonstrated in a healthy mammary tissue context[14], the CD10 protein is still involved in the maintenance of stemness properties of transformed mammary epithelial cells. This was substantiated by the observation that only sorted CD10+ MC26 transformed cells were able to progressively generate CD10-negative cells (FIG. 13). To preclude that a differential cell proliferation rate could progressively imbalance the representation of both subpopulations, the inventors verified that positive and negative sorted CD10 fractions displayed the same doubling time (FIG. 14). Lastly, the inventors sorted M1B26 cells based on their CD10 surface expression and assayed their growth capacity on soft-agar. Interestingly, CD10+M1B26 cells generated significantly more clones than CD10-negative cells (FIG. 15). Next, the inventors investigated whether CD10 was required for soft-agar clone formation by (i) sorting CD10+ cells from either MC26 or M1B26 transformed cells and knocking down CD10 expression using shRNA (FIG. 16 and FIG. 46), and (ii) exogenously expressing CD10 in CD10-negative MCF10A-CT, MC26 and M1B26 cells (FIG. 17 and FIG. 47). The inventors observed no significant differences between the conditions tested, indicating that CD10 expression is not involved in mammary epithelial cell transformation.

Therefore, CD10 remains involved in maintaining immature stem cell properties in transformed mammary epithelial cells without being implicated in their transformation process. It also suggests that CD10-expressing cells represent a subpopulation of cells with immature properties that could contribute to maintaining tumor heterogeneity.

Molecular Signature of CD10-Expressing Immature Cells

Given the enrichment in CD10-expressing cells upon transformation in our MCF10A models and the correlation between CD10-positive cells and their ability to form soft-agar clones, the inventors hypothesized that identifying transcriptomic variations associated with CD10 status may improve our understanding of functional differences between transformed cells. The inventors sorted CD10+ and CD10− sub-populations of cells from MCF10A-CT, MC26 and M1B26 cell lines and performed a transcriptomic analysis of sorted cells (FIG. 18). As described below, the most significant differences in term of gene expression between CD10− and CD10+ populations were found in the MCF1 OA-CT cells. The 160 most expressed genes in MCF10A-CT CD10+ compared to CD10− cells (including CD10 itself, i.e. MME for Membrane MetalloEndopeptidase) were selected to define a CD10-associated molecular signature (Table 5). Gene ontology analysis of this signature revealed a strong enrichment in genes involved in the G2/M phase of the cell cycle (FIG. 19).

Figure 20:
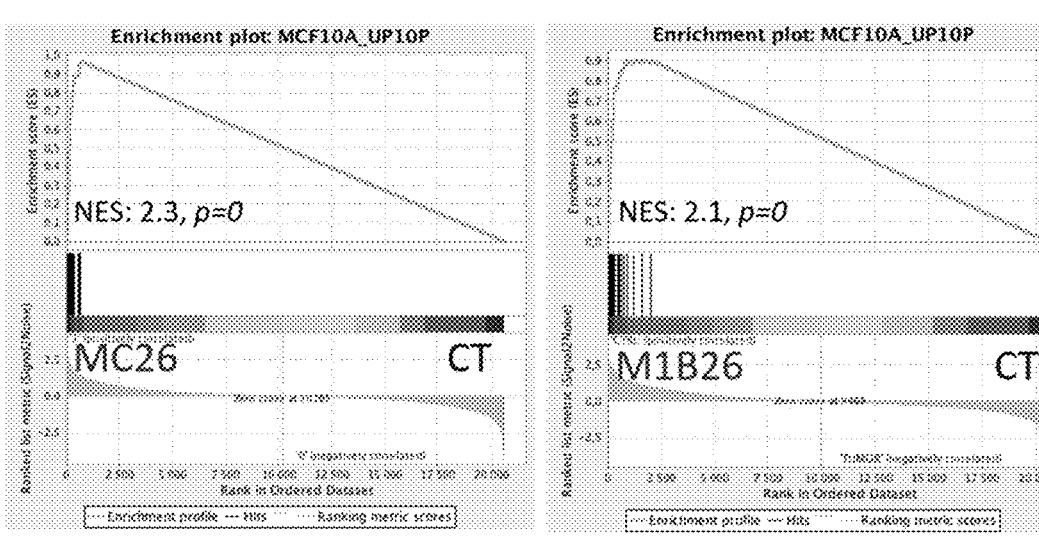
FIG. 20 is a GSEA analysis of CD10 signature enrichment in MC26 cells and M1B26 cells versus CT cells (left and right panels, respectively).
Figure 21:
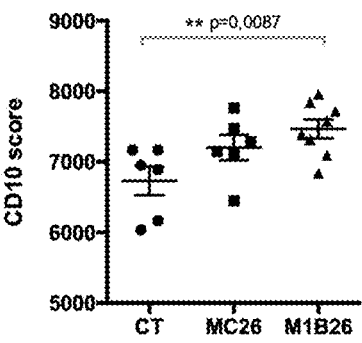
FIG. 21 is a representation of the CD10 score of the different MCF10A-derived cell lines representing the progression model of luminal breast cancer with non-transformed (CT, n=6), early (C26, n=6) and more aggressive (M1B26, n=8) transformed models determined by several different replicates obtained by Affymetrix array.
Figure 22:
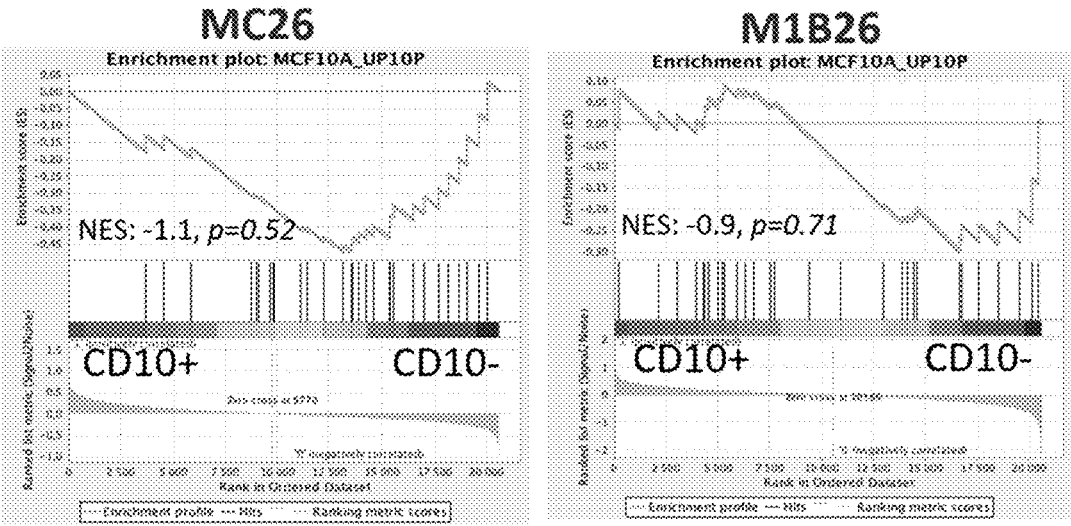
FIG. 22 is a GSEA analysis of CD10 signature enrichment in CD10$^+$ versus CD10-fractions of the MC26 and M1B26 cell lines (left and right panels, respectively).

Interestingly, the CD10 enrichment score was higher in unsorted MC26 or M1B26 cells compared to CT cells (FIG. 20), and seemed to increase with the level of cell transformation (FIG. 21). However, the link between this signature and CD10-expressing cells was lost in transformed MC26 and M1B26 cells as no enrichment of the CD10 signature was detected in both CD10-negative or CD10-positive cells (FIG. 22). Altogether, our data indicate that transformed MCF10A retain their immature properties linked to CD10 expression despite the phenotypic plasticity of the CD10 cell surface expression observed post-transformation. These observations also suggest that the transformation process that leads to MC26 and M1B26 cells could have occurred preferentially within the CD10+ fraction of MCF10A-CT cells.

Figure 23:
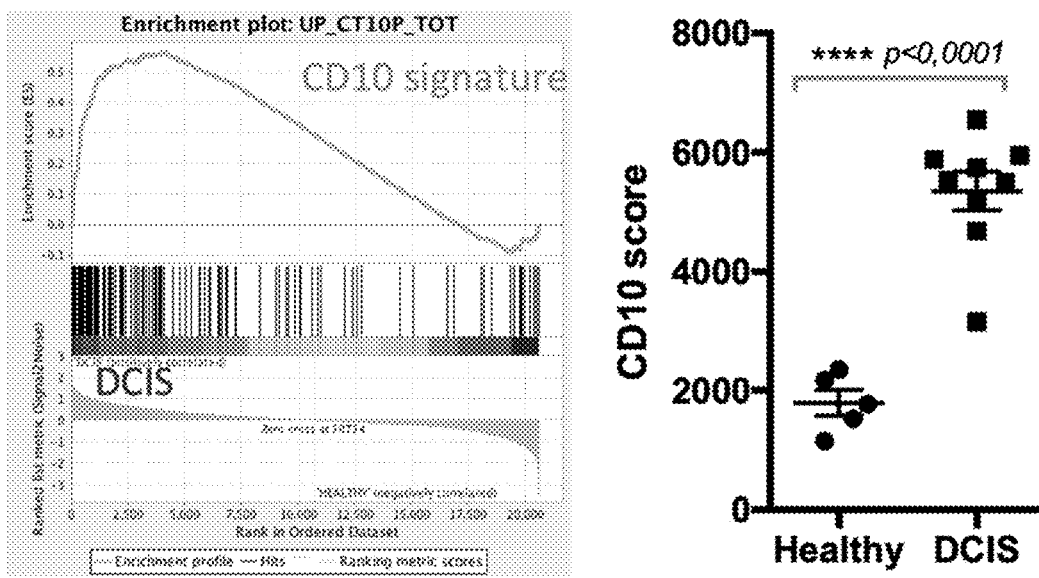
FIG. 23 Left panel: GSEA analysis of CD10 signature enrichment in human primary DCIS versus healthy mammary gland (Series GSE21422), right panel: ssGSEA quantitation of CD10 signature score in healthy and DCIS samples from GSE21422.

The CD10-Score is Associated with Poor Patient Outcome and Patterns of Drug Response in Breast Cancer Next, the inventors tested the level of the CD10-score in primary breast cancers compared to healthy tissues. The inventors used available transcriptomic data from human DCIS and normal breast tissue, obtained using the same array-based platform. The CD10-gene enrichment signature was significantly higher in DCIS versus healthy tissues (FIG. 23).

Figure 24:
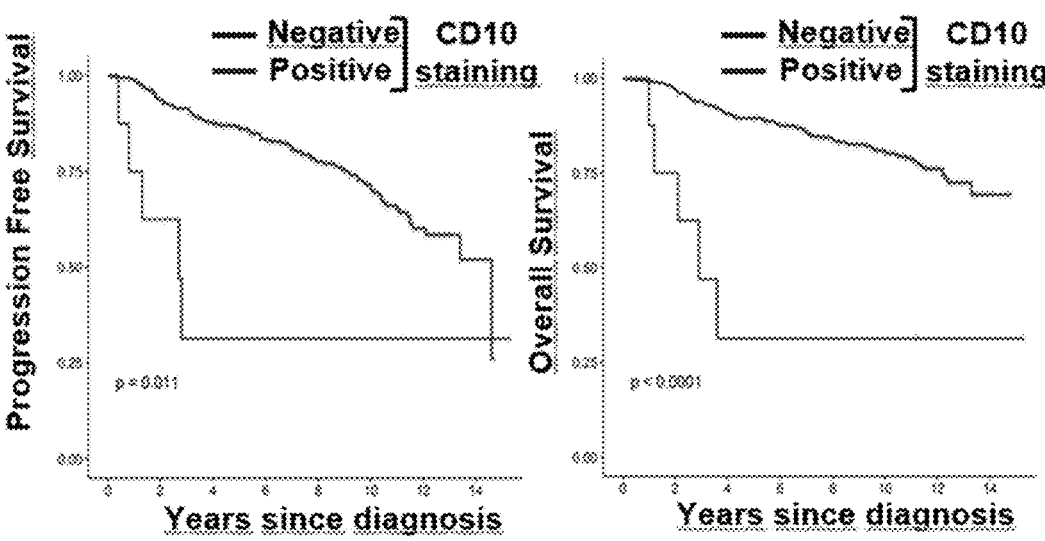
FIG. 24 represents Kaplan-Meier plots of overall (left panel) and progression-free (right panel) patients survival in function of CD10 protein expression measured by IHC in a tumor microarray (TMA440) from the Centre Léon Bérard.

The importance of CD10 in breast cancer cells was confirmed by CD10 IHC staining of a 438 breast tumors microarray (TMA)[17] that revealed a significant correlation between CD10-positive tumor cells and poor overall (OS) and progression-free survival (PFS) (FIG. 24). Of note, among the eight CD10+ tumors, four were of the triple-negative molecular subtype (Table 6).

TABLE 5

| CD10 molecular signature | | | | | | | |
|---|---|---|---|---|---|---|---|
| FAM83D | CKAP2L | PI3 | FAM76B | SRGN | KIF23 | CASC5 | NUDCD2 |
| TTK | KIF20A | FPR1 | ATP6V0E1 | CFB | SHCBP1 | ORC6 | CFLAR |
| PDZK1IP1 | DCN | RAB2A | CYP1B1 | CENPE | NUCKS1 | SAA2 | NEK2 |
| FAM64A | SFTPB | ESPL1 | TMEM194A | CKAP2 | CEP55 | FANCD2 | SOD2 |
| CENPA | AKR1C1 | FAP | NDC80 | ADRB2 | COL12A1 | KANK2 | ATAD2 |
| NUSAP1 | SPAG5 | S100A7 | KIF4A | KIF14 | NCAPD3 | STIL | HPSE |
| BUB1 | IL1R2 | DAPK1 | AURKB | KPNA2 | SUSD2 | NAMPT | SULT1E1 |
| DLGAP5 | CCNA2 | RPL37A | CCNB1 | CENPF | GPR64 | IFI44L | HMGB2 |
| PRC1 | GAS2L3 | SPC24 | KIF2C | FAM72A | ENO1 | NALCN | SPC25 |
| SGOL2 | AURKA | SCNN1G | NCAPH | KCNK5 | METTL9 | FN1 | DDX17 |
| CDC25C | KIF18B | CCNF | NEURL1B | CDCA3 | CD59 | HEY1 | RPS27L |
| SERPINE2 | GOLGA8A | AKR1B1 | ASPM | COL8A1 | TMEM139 | S1PR3 | CLIC3 |
| AOX1 | GALNT15 | RANBP17 | DKK1 | CNTN3 | FLRT3 | SERPINA5 | CCNG2 |
| CDCA5 | TOP2A | IL1RL1 | PAPSS2 | CENPJ | FIBIN | OSBPL7 | NNMT |
| CDK1 | MME | SUV39H1 | FOXQ1 | SCNN1B | ERAP1 | SAMSN1 | LIMCH1 |
| AKR1B10 | LCN2 | CENPA | HMMR | TACC3 | MGLL | S100A4 | DDIAS |
| DEPDC1 | FBXO5 | EEF1D | UBE2C | DEPDC1B | SNCAIP | SH3RF3 | DAB2 |
| ANLN | S100P | HJURP | MCM8 | NCAPG2 | MLPH | TNFAIP6 | PLSCR4 |
| C1S | CXCL8 | NCAPG | SMC4 | HSP90B1 | MKI67 | CYP4B1 | SLFN5 |
| CCDC71L | EHF | BUB1B | DIAPH3 | C1R | TAF5 | MASTL | SLC39A8 |

TABLE 6

| | N | Luminal A N = 236 | Luminal B N = 145 | HER2 seul N = 12 | Triple neg. N = 45 | Combined N = 438 | Test Statistic |
|---|---|---|---|---|---|---|---|
| CD10 (cat.) | 383 | | | | | | $\chi_3^2 = 18.54,\ P < 0.001^1$ |
| positive | | 1% (1) | 1% (2) | 9% (1) | 11% (4) | 2% (8) | |
| CD10 (% marked cells) | 383 | | | | | | $\chi_{15}^2 = 43.26,\ P < 0.001^1$ |
| 0 | | 99% (196) | 99% (135) | 91% (10) | 89% (34) | 98% (375) | |
| 20 | | 1% (1) | 0% (0) | 0% (0) | 0% (0) | 0% (1) | |
| 30 | | 0% (0) | 0% (0) | 0% (0) | 3% (1) | 0% (1) | |
| 70 | | 0% (0) | 0% (0) | 0% (0) | 5% (2) | 1% (2) | |
| 80 | | 0% (0) | 1% (1) | 0% (0) | 0% (0) | 0% (1) | |
| 90 | | 0% (0) | 1% (1) | 9% (1) | 3% (1) | 1% (3) | |
| CD10 (stroma) | 379 | | | | | | $\chi_3^2 = 1.78,\ P = 0.62^1$ |
| + | | 80% (158) | 79% (106) | 64% (7) | 78% (28) | 79% (299) | |

CD10 staining by IHC in TMA

Figure 25:
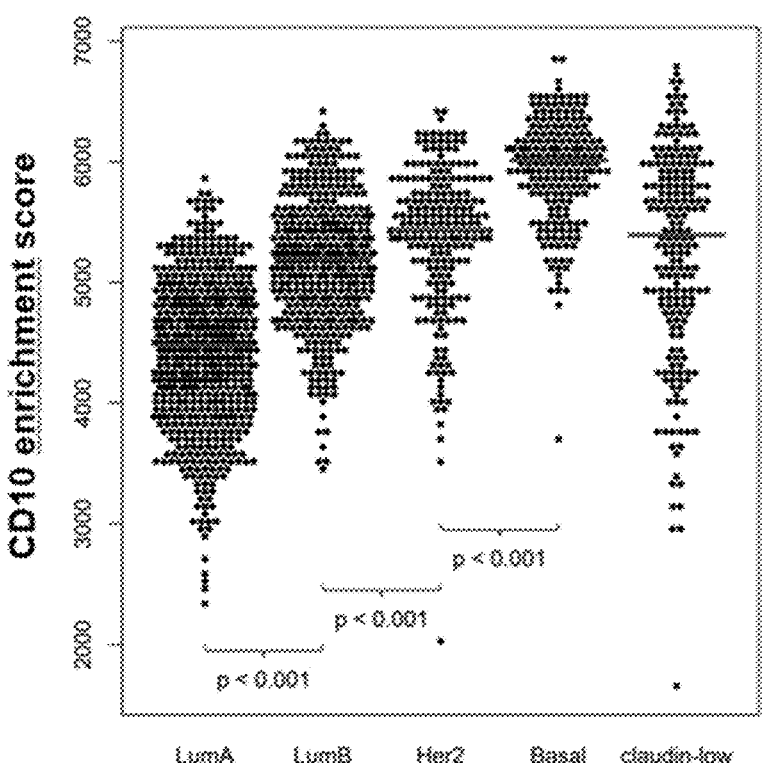
FIG. 25 represents the ssGSEA enrichment score (ES) of CD10 signature in tumor samples of the METABRIC database according to the molecular classification of breast cancers.
Figure 48:
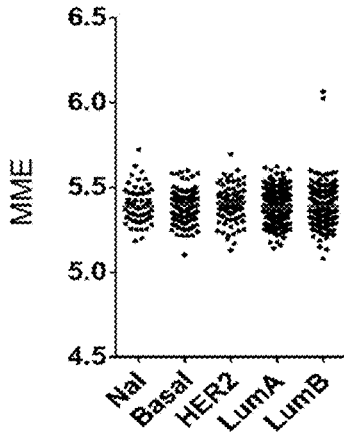

Only 2% of breast cancers tested (8/438 of the TMA) displayed an adequate intra-tumor CD10 staining to be considered as positive (20% CD10-positive cells), while no significant difference was observed for CD10 staining outside the tumor area (Table 3). In order to evaluate whether the CD10-score was more discriminant than the CD10 protein immunostaining, the inventors tested the CD10-score in the METABRIC dataset, that includes over 2,000 breast tumors. No difference was observed among breast cancer PAM50 subtypes in CD10 (i.e. MME) transcript levels (FIG. 48) This comparable CD10 expression level between subgroups is reminiscent of the dissociation observed between cell membrane CD10 status and gene enrichment signature expression in our transformed MCF10A cell models (FIG. 22). Although the CD10 transcript level was unaltered, a significant enrichment in the CD10-score was observed in the different breast cancer subtypes (FIG. 25).

Figure 26:
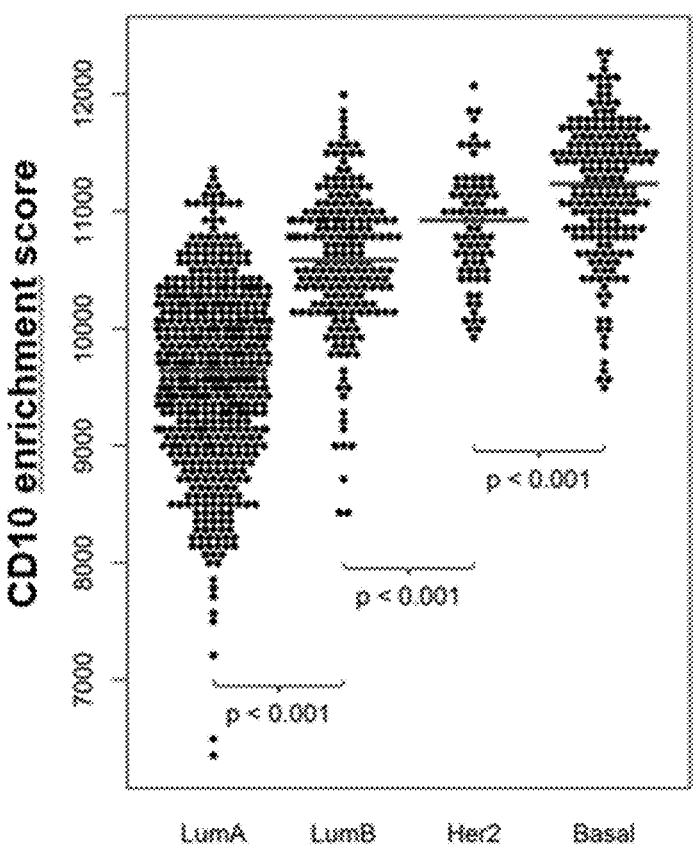
FIG. 26 represents the ssGSEA enrichment score (ES) of CD10 signature in tumor samples of the TCGA database according to the molecular classification of breast cancers.
Figure 27:
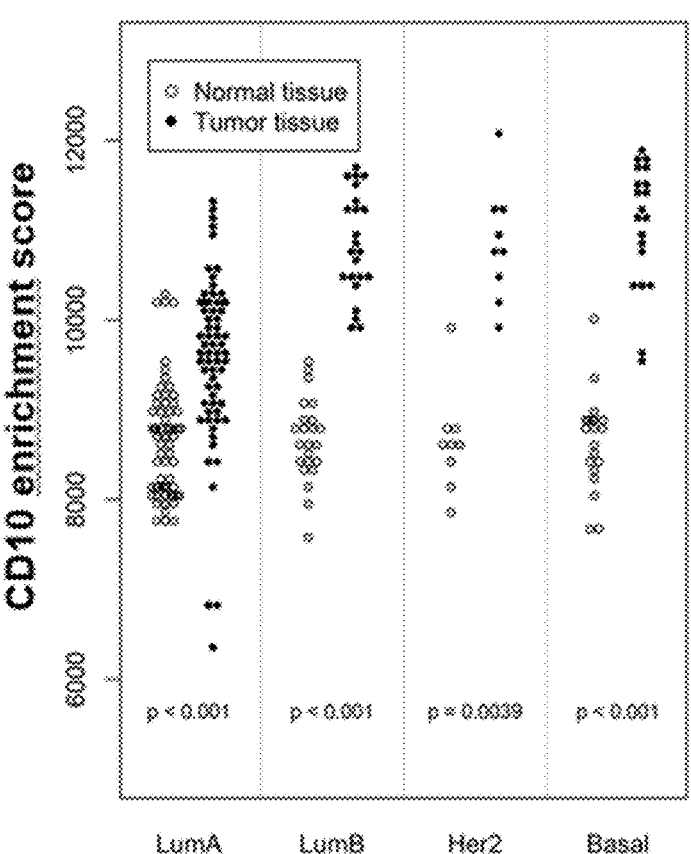
FIG. 27 represents ES of CD10 signature in normal or tumoral breast tissue in transcriptomic data from the TCGA's pan-cancer atlas. Each sample is represented by a dot and the medial score by a bar.
Figure 28:
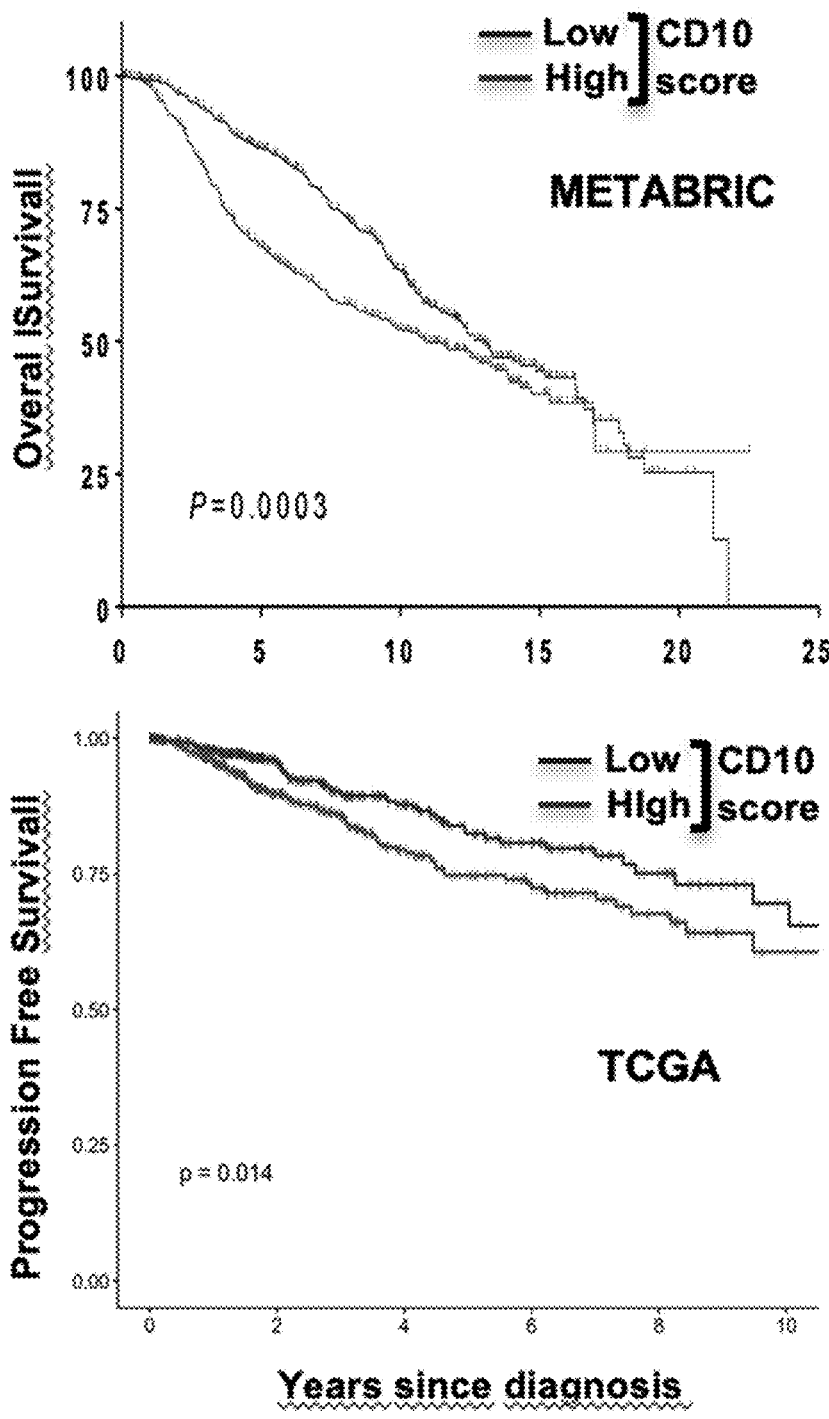
FIG. 28 represents Kaplan-Meier plots of overall patients survival in the METABRIC database (upper panel) or of progression free survival (lower panel) of breast cancer patients in the TCGA's pan-cancer atlas in function of CD10 signature ES.

This was confirmed in the TCGA-BRCA dataset (FIG. 26). Of note, the CD10-score enrichment varied significantly between the different breast cancer subtypes, being significantly higher in the basal subtype compared to the luminal A subtype. By conducting a paired analysis in the TCGA-BRCA dataset the inventors could also compare gene expression profiles between breast invasive carcinoma cells and their surrounding healthy cells. This revealed an impressive increase of the CD10-score in tumor cells in all breast cancer subtypes (FIG. 27). When METABRIC and TCGA breast cancer patient were divided into low and high CD10-score, patients with a low score had a significantly better OS, independently of the PAM50 subtype in both cohorts (FIG. 28).

TABLE 7

Correlation of the CD10-with drug response of Sanger cell lines

| Drug | Synonyms | Targets | r | P (two-tailed) | Nb of samples |
|---|---|---|---|---|---|
| PF-02341066 | Crizotinib, KIN | MET, ALK | −0.5971 | 0.0242 | 14 |
| AZ07762 | AZD 7762 | CHK1/2 | −0.49 | 0.0018 | 38 |
| DMOG | Dimethyloxal | Prolyl-4-Hydrolase | −0.3884 | 0.0133 | 40 |
| Thapsigargin | | ATPase, Ca++ transpo | −0.381 | 0.0153 | 40 |
| CHIR-99021 | CT 99021 | GSK3B | −0.3755 | 0.0169 | 40 |
| AZD6244 | | MEK1/2 | −0.3289 | 0.0469 | 37 |
| JNJ-26854165 | | MDM2 | −0.3259 | 0.049 | 37 |
| JNK-9L | KIN001-204 | JNK | 0.3147 | 0.048 | 40 |
| PF-562271 | (KIN001-205) | FAK | −0.313 | 0.0493 | 40 |
| Nutlin-3a | Nutlin-3a (−) | MDM2 | 0.3329 | 0.0411 | 38 |
| 17-AAG | 17-AAG | MSP90 | 0.4029 | 0.0122 | 38 |
| AZD8055 | AZD8055 | mTORC1/2 | 0.41 | 0.0106 | 38 |
| Temsirolimus | CCI-779 | MTOR | 0.4313 | 0.0069 | 38 |
| EHT 1864 | | Rac GTPases | 0.4532 | 0.0043 | 38 |
| PF-4708673 | | P70 S6KA | 0.8003 | 0.0016 | 37 |
| ATRA | Tretinoin | Retinoic acid and retin | 0.5528 | 0.0003 | 38 |

Figure 29:
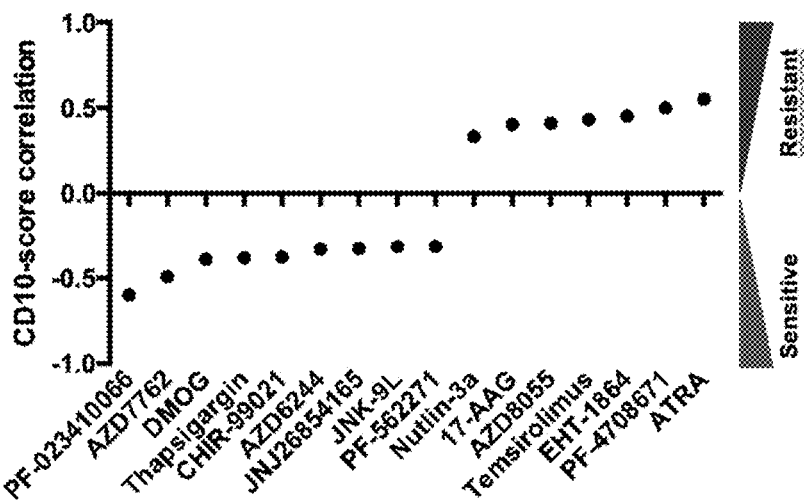
FIG. 29: CD10 signature predicts response to potential anti-cancer drugs. Using transcriptomic data from the "Genomics of drug sensitivity in cancer" project from the Sanger Institute, ES of CD10 signature in 51 human breast cancer and correlated with their resistance to 142 drugs. Drugs with correlation coefficients r with p<0.05 are shown.
Figure 30:
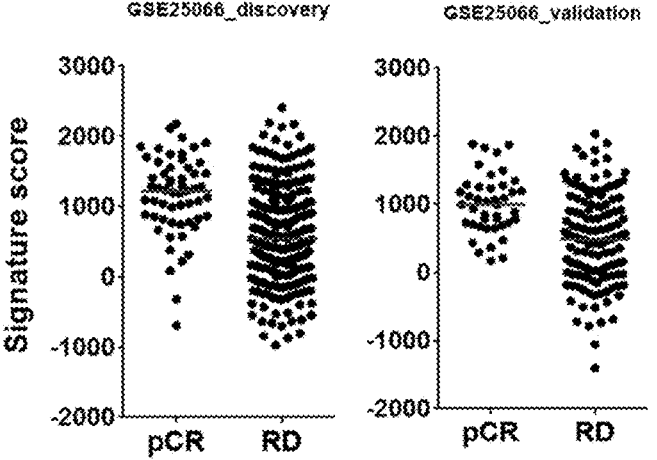
FIG. 30 CD10 signature ES in discovery (left panel) and validation (right panel) cohorts of invasive breast cancer patients showing a pathologic complete response (pCR) or a residual disease (RD) after taxane-anthracycline chemotherapy.
Figure 33:
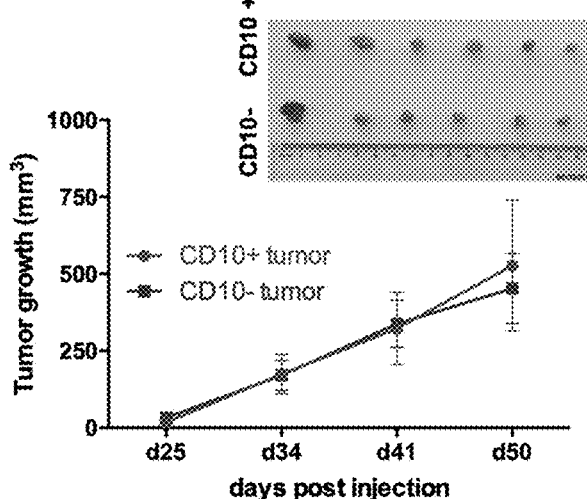
FIG. 33 shows that C4-2B cell line was sorted for CD10, then 10$^5$ cells were engrafted subcutaneously in immuno-deficient mice. Tumor growth was measured over time and after 6 weeks mice were sacrificed and tumors collected.
Figure 34:
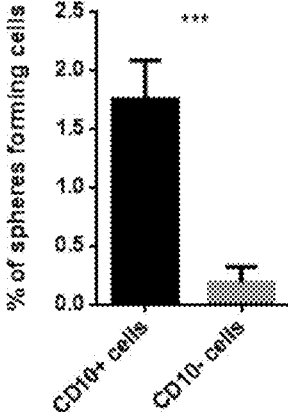
FIG. 34 C4-2B cell line was sorted for CD10, then 100 CD10$^+$ or CD10$^-$ cells were seeded in sphere assay (as described in FIG. 1).
Figure 35:
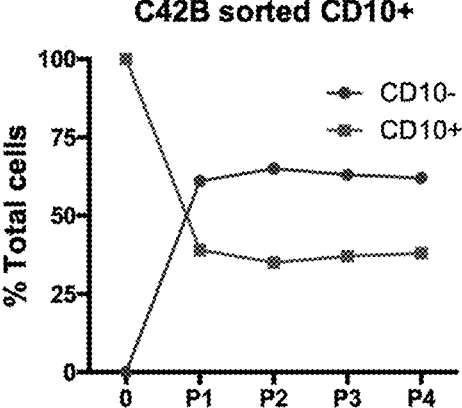
FIG. 35 C4-2B CD10$^+$ cells were sorted by flow cytometry and grown in culture, CD10 membrane expression was then followed over passages by flow cytometry.
Figure 36:
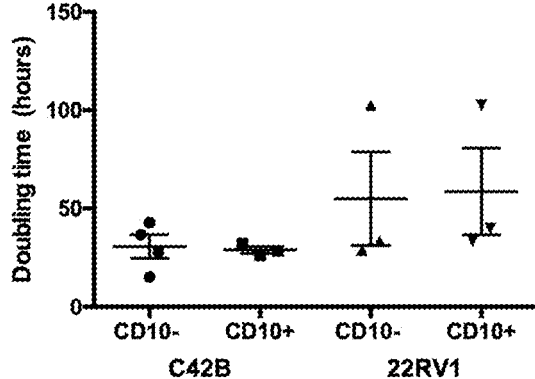
FIG. 36 CD10$^+$ and CD10$^-$ cells from the C4-2B and 22RV1 cell lines were sorted by flow-cytometry, grown in culture and their proliferation was followed over time to calculate their respective doubling time.
Figure 37:
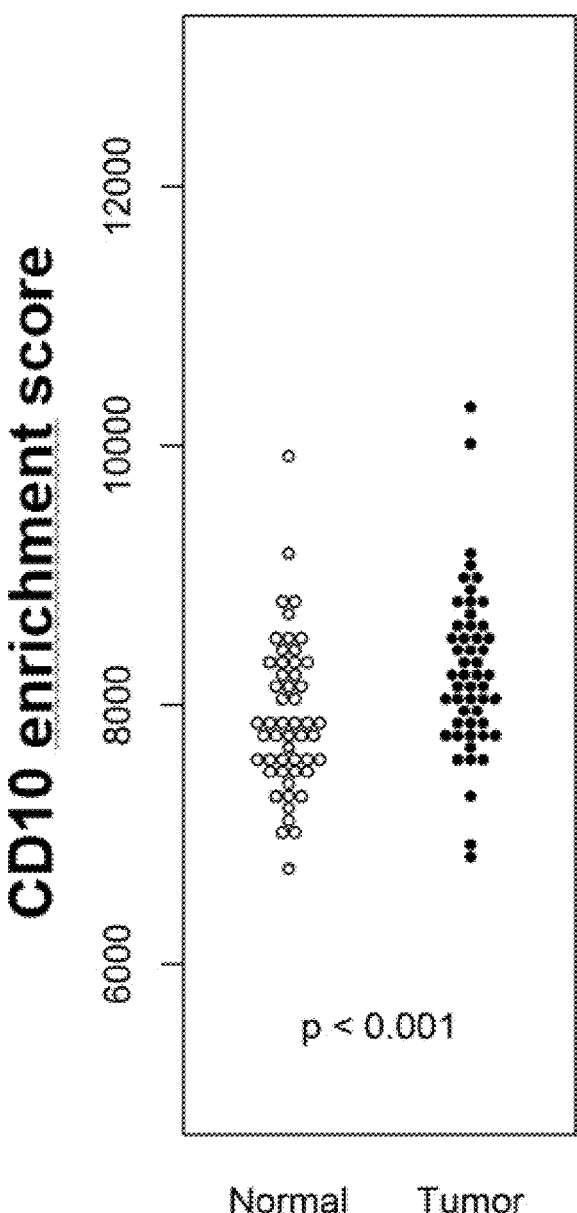
FIG. 37 ES of CD10 signature in normal or tumoral prostate tissue in transcriptomic data from the TCGA's pan-cancer atlas, representation as in FIG. 4d.
Figure 38:
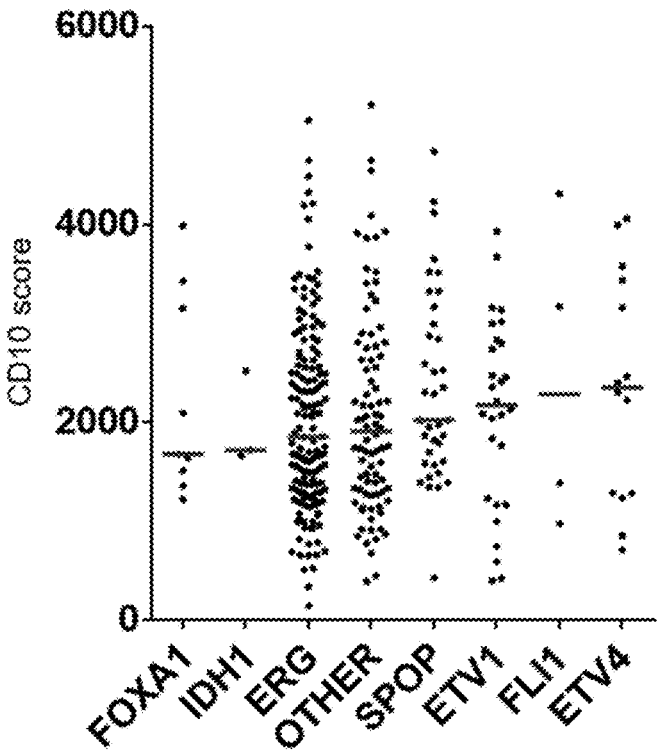
FIG. 38 ES of CD10 signature in prostate tumor samples from the TCGA's pan-cancer atlas subdivided according to their molecular taxonomy. Representation as in f. h: Kaplan-Meier plot of prostate cancer patients progression-free survival in function of CD10 signature ES.
Figure 39:
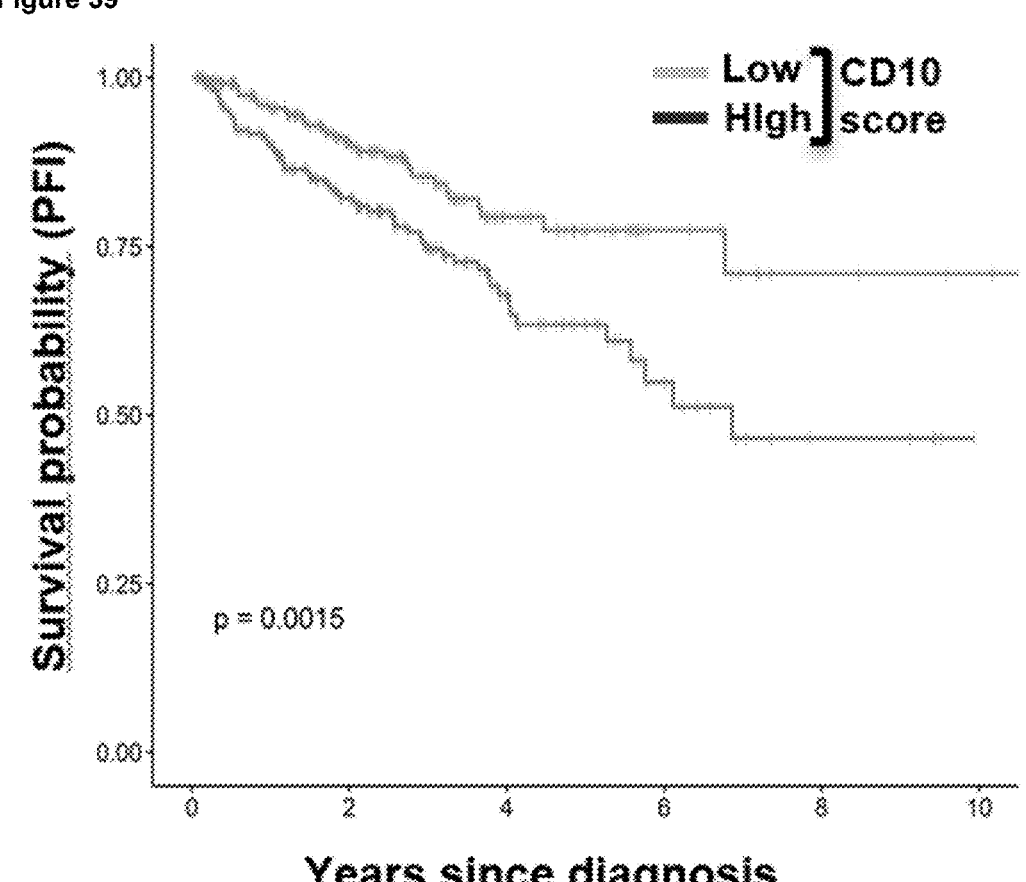
FIG. 39 Kaplan-Meier plot of prostate cancer patients progression-free survival in function of CD10 signature ES.
Figure 49:
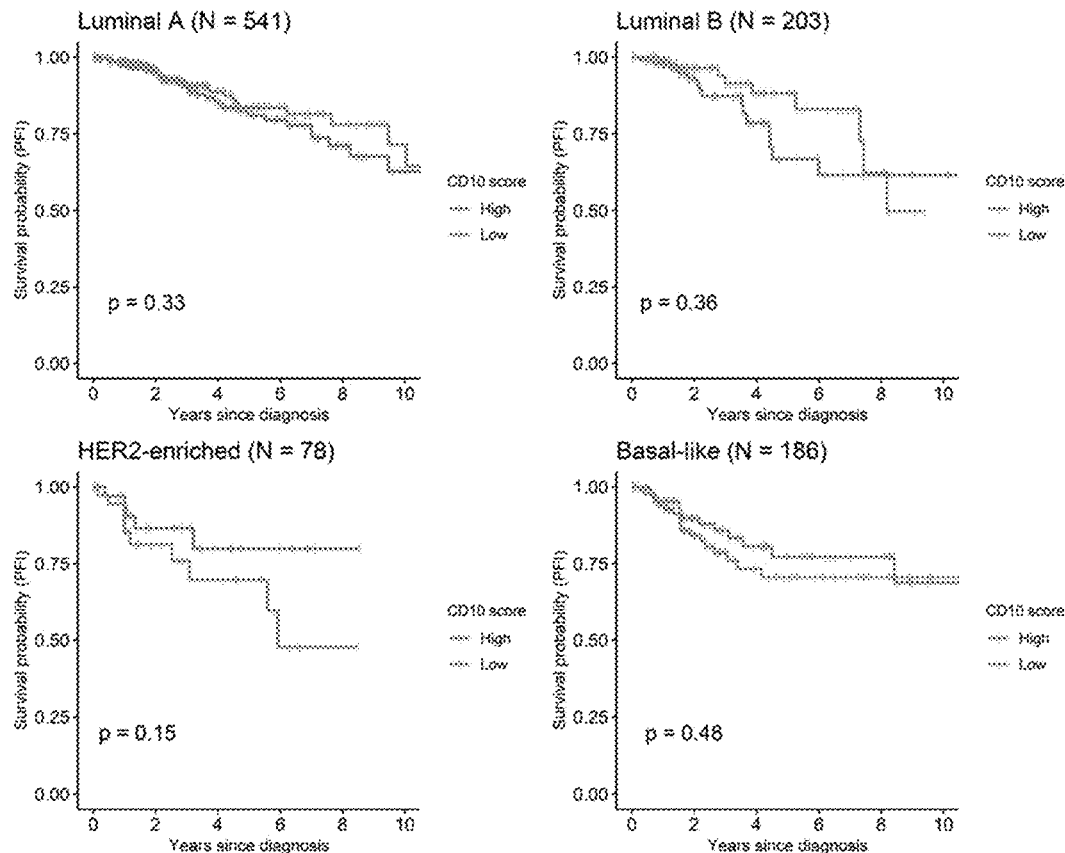
Figure 50:
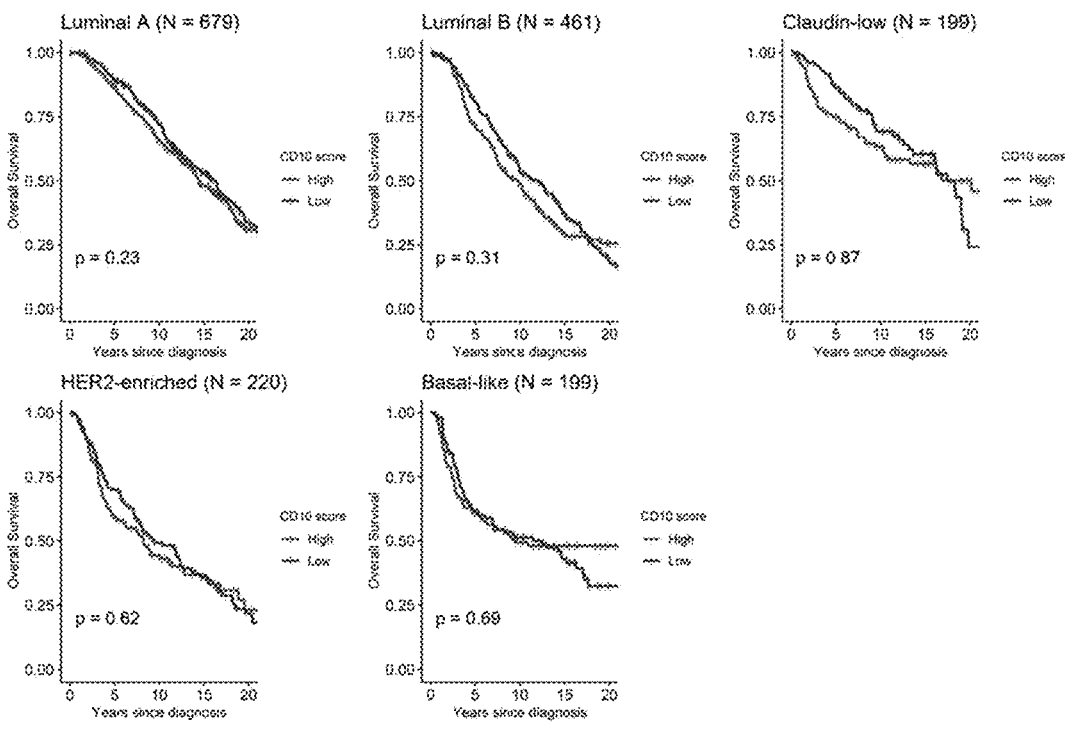
FIG. 50 Kaplan-Meier plots of breast cancers patients survival from the METABRIC cohort.
Figure 51:
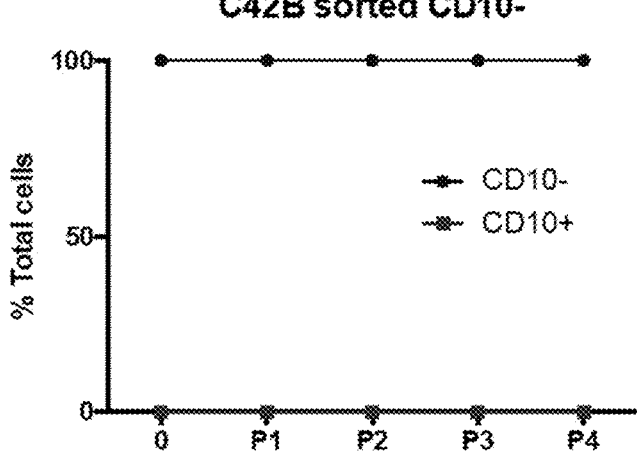
FIG. 51: Follow-up of CD10 membrane expression in CD10$^-$ sorted C4-2B cells. CD10$^-$ C4-2B cells were sorted by flow cytometry and cultured for 4 passages. Percentages of CD10$^-$ and CD10$^+$ were measured at each passage by flow-cytometry FIG. 52 Plot comparing the ssGSEA score for the full list of 160 genes, and the ssGSEA score obtained for the reduced list of 82 genes. The Pearson coefficient is equal to 0.98, showing the effectiveness of the reduced signature compared to the original full signature.

However, this prognostic value of the CD10-score could not be evidenced when stratifying the analysis by breast cancer subtypes (FIGS. 49 and 50). Using gene expression profiles from breast cancer cell lines included in the Cancer Cell Line Encyclopedia[30], the inventors evaluated the correlation between CD10-score and the IC50 levels of 144 drugs. The CD10-score was correlated with drug response, either indicative of resistance or of sensitivity, depending on the drug (FIG. 29 and Table 4). Furthermore, analyzing the CD10-signature in two independent cohorts of invasive breast cancer treated with taxane-anthracycline chemotherapy in the neoadjuvant setting revealed that, in this settings, the CD10-score could be associated with a pathological response (FIGS. 30 and 31). Altogether, these data strongly suggest that the CD10-signature may help tailor systemic therapy in patients with early stage breast cancer. As in Breast Cancer, the CD10-Score is Independent of Cell Membrane CD10 Expression in Prostate Cancer The inventors then evaluated whether properties of CD10-transformed cells are specific to breast cancer or could be shared with other malignant tumors of epithelial-origin. Breast and prostate epithelium share a number of common properties including the fact that they are both primarily hormone-dependent cancers. Moreover, CD10 has been implicated in the transformation process of prostate epithelial cells. The inventors thus evaluated the CD10-molecular signature in representative prostate cancer cell lines (C4-2B and 22Rv1). Like in our MCF10A-derived transformed models (FIG. 22), there was no strong association of this signature with the CD10 cell membrane status for both prostate cell lines as albeit a significant enrichment was detected in CD10-positive cells by GSEA, a large proportion of genes of the CD10 signature are upregulated in the CD10-negative cells of both cell lines (FIG. 32). Similar engraftments in mice of both sorted CD10 cells confirmed that both sub-fractions contained transformed cells (FIG. 33). However, the CD10-cell membrane expression remained linked to immature cell properties in C4-2B cell line model as indicated by their higher capacity to generated spheres (FIG. 34) and to restore phenotypic heterogeneity (FIG. 35 and FIG. 51), as previously observed in MCF10A models (FIGS. 9 and 13). Moreover, no difference in cell doubling time was measured for CD10-positive and CD10-negative sorted C4-2B and 22Rv1 cells (FIG. 36). Data from prostate cancer available within the TCGA Pan-Cancer database revealed a higher CD10-score in tumor cells (FIG. 37) and poor differential expression of the CD10 score between different prostate cancer types (FIG. 38). In contrast to breast cancer (FIG. 25 and FIG. 26), the CD10-score in prostate cancer subtypes remained relatively low (FIG. 37). Despite that, when Pan-Cancer patient samples with prostate cancer were divided into low and high CD10-signature, patients with a low CD10-score displayed a significantly better progression-free survival (FIG. 39). This indicates that the CD10-score might be of prognostic value even in cancers with a lower average CD10-score. In addition, our data suggest that the CD10 cell membrane expression is indicative of cells with stem-like activities, and unveils that the CD10-score and cell membrane-associated properties are similar in breast and prostate cancers.

Figure 40:
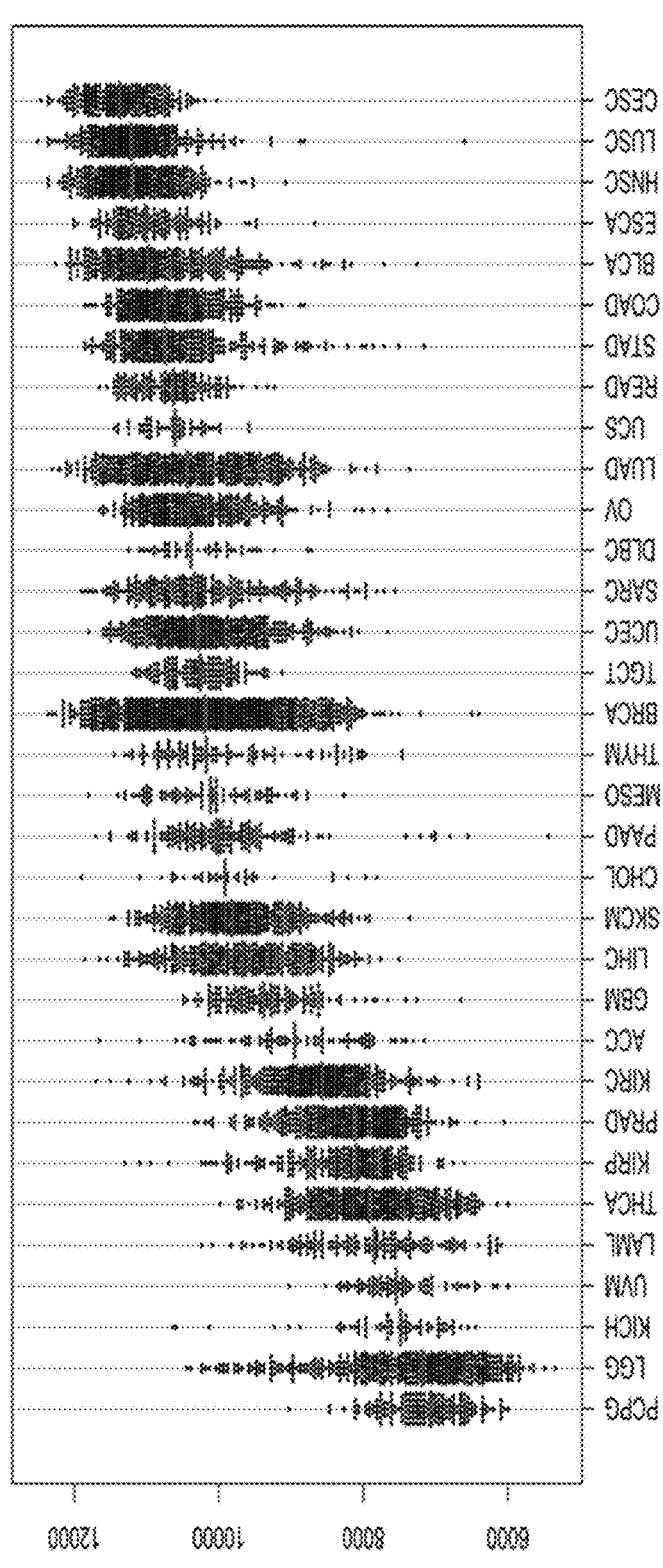
FIG. 40 represents ES of CD10 signature in tumor samples of the PAN-CANCER database according to cancer type. ACC: adrenocortical carcinoma, BLCA: bladder urothelial carcinoma, BRCA: breast invasive carcinoma, CESC: cervical SCC and endocervical adenocarcinoma, COAD: colon adenocarcinoma, DLBC: lymphoid neoplasm diffuse large B-cell lymphoma, GBM: glioblastoma multiform, HNSC: head and neck squamous cell carcinoma, KICH: kidney chromophobe, KIRC: kidney renal clear cell carcinoma, KIRP: kidney renal papillary cell carcinoma, LGG: brain lower grade glioma, LIHC: liver hepatocellular carcinoma, LUAD: lung adenocarcinoma, LUSC: lung squamous cell carcinoma, OV: ovarian serous cystadenocarcinoma, PRAD: prostate adenocarcinoma, READ: rectum adenocarcinoma, SKCM: skin cutaneous melanoma, STAD: stomach adenocarcinoma, THCA: thyroid carcinoma, UCES: uterine corpus endometrial carcinoma, UCS: uterine carcinosarcoma.
Figure 41:
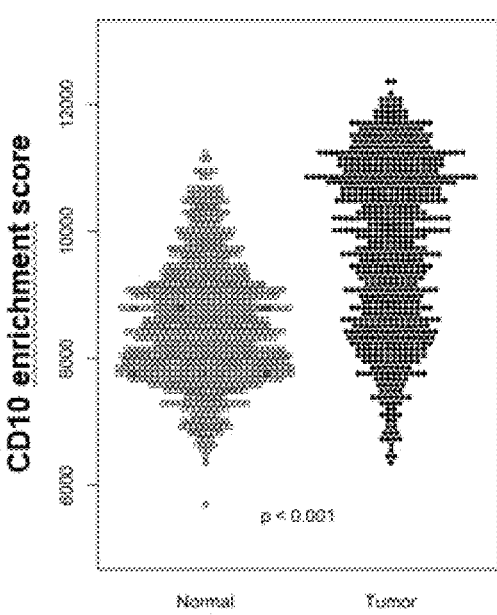
FIG. 41 represents ES of CD10 signature in all normal and tumor samples from the TCGA's pan-cancer atlas.
Figure 42:
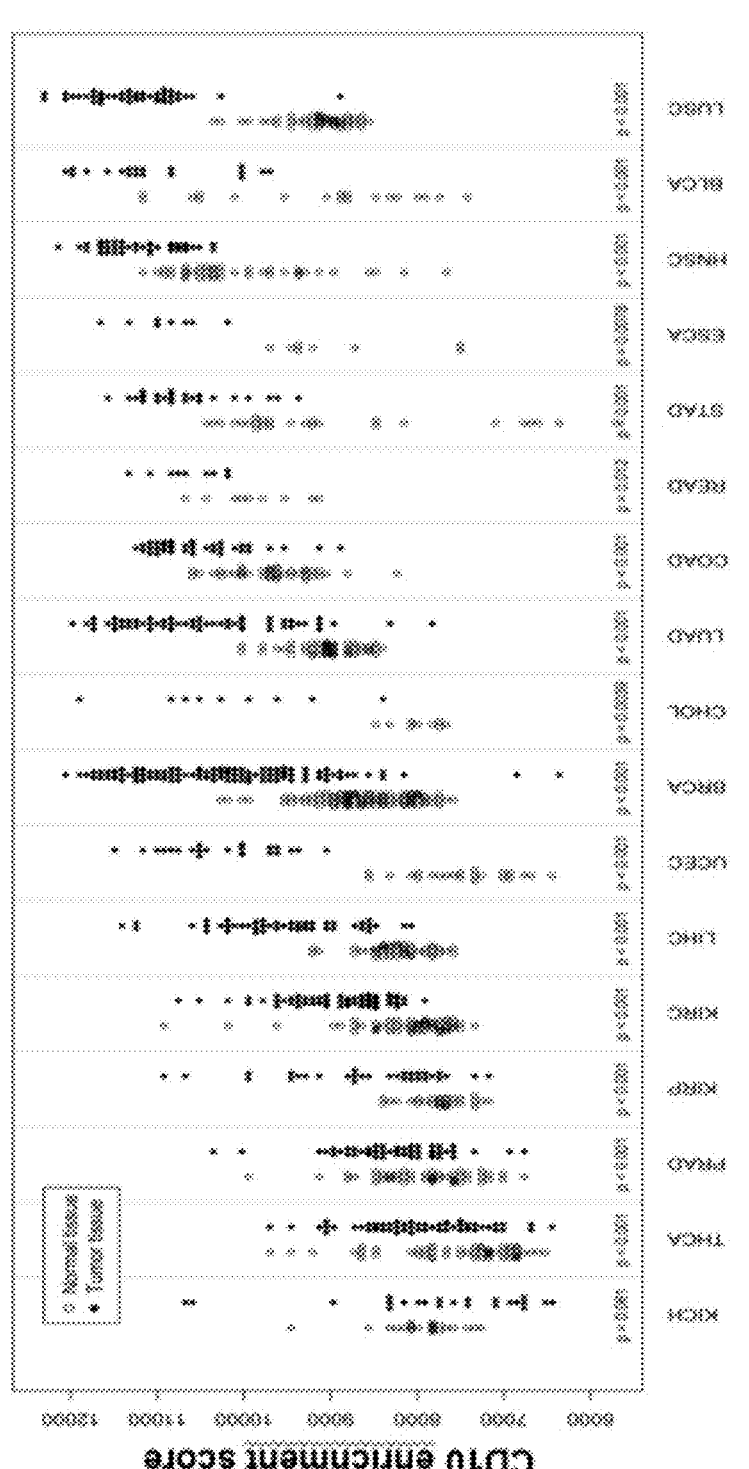
FIG. 42 represents a comparison of CD10 signature ES between cancer types and their corresponding normal tissue from the TCGA's pan-cancer atlas.
Figure 43:
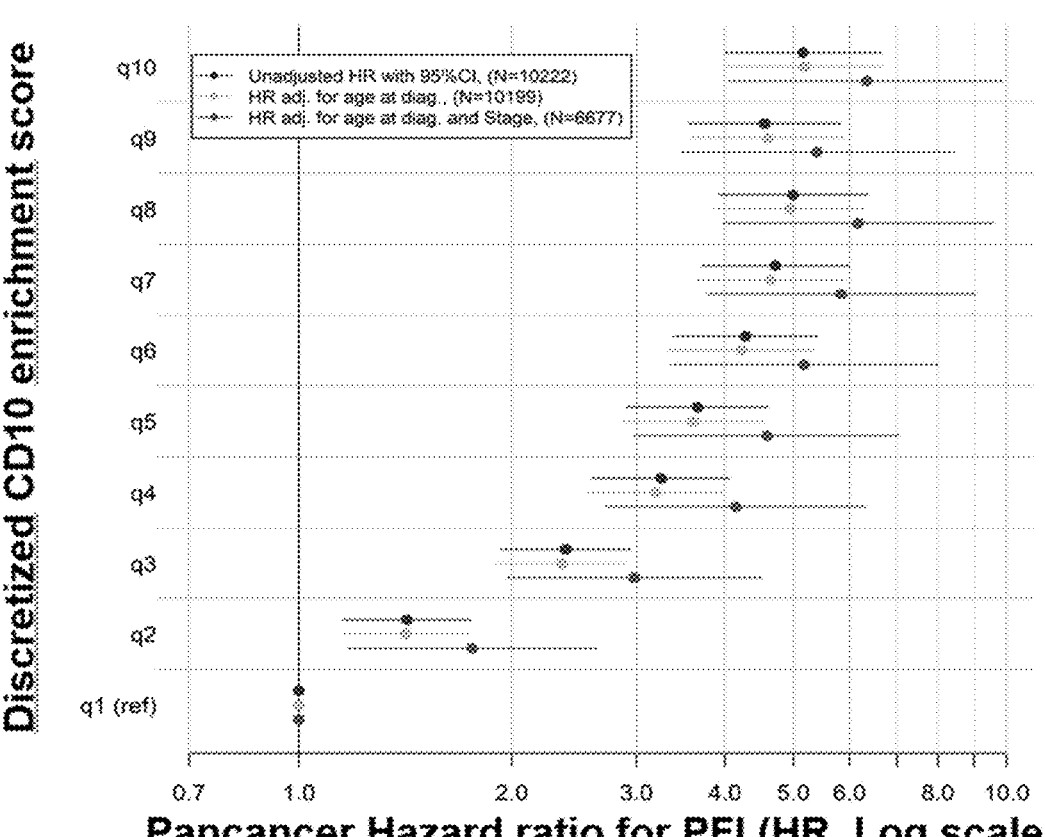
FIG. 43 Overall Pan-Cancer analysis of the effect of CD10 score on survival in the TCGA's Pan-Cancer atlas. All tumor samples were pooled and the effect of the CD10 enrichment score discretized by deciles on survival outcome was evaluated using unadjusted (blue marks) or multivariate (grey marks after adjustment for age at diagnostic and purple marks after adjustment for both age at diagnostic and cancer stage) Cox models. Dots show the hazard ratio for PFI (progression-free interval) and adjacent bars the 95% confidence interval.

CD10 Signature is a Biomarker of Poor Prognosis in a Variety of Solid Tumor Types The inventors then investigated whether this CD10-score had a prognostic value in other types of cancer, analyzing a large series of tumor samples from the TCGA Pan-Cancer database. The CD10-score was highly variable across different carcinomas (FIG. 40). Notably, our analyses showed a stringent enrichment in the CD10-score in tumor cells compared to non-tumor cells in all tumors (with the exception of kidney chromophobe tumors (KICH)), thus validating the general association of the CD10-signature with the transformation status (FIG. 41 and FIG. 42). To get an overall picture summarizing the prognostic value of the CD10-Score over all tumor types, the inventors adjusted multivariable stratified Cox models with a different baseline hazard for each tumor type. This provided pan-cancer hazard ratios estimates for the CD10-score effect where the variations in survivals inherent to the tumor type was treated as a "nuisance parameter", thus reflecting the "true" prognostic value of the CD10-score. Thanks to the high statistical power offered in this pan-cancer analysis, the CD10-score was discretized by deciles, with more than 1,000 patients in each decile, to being able to finely investigate a putative dose-response relationship of the effect of the CD10-score on survival outcome. The results of these stratified Cox models are shown on (FIG. 43).

This modeling revealed a strong risk gradient for the effect of the CD10-score, with gradual increase of hazard ratios for progression-free survival going up to HR=5.15

Figure 44:
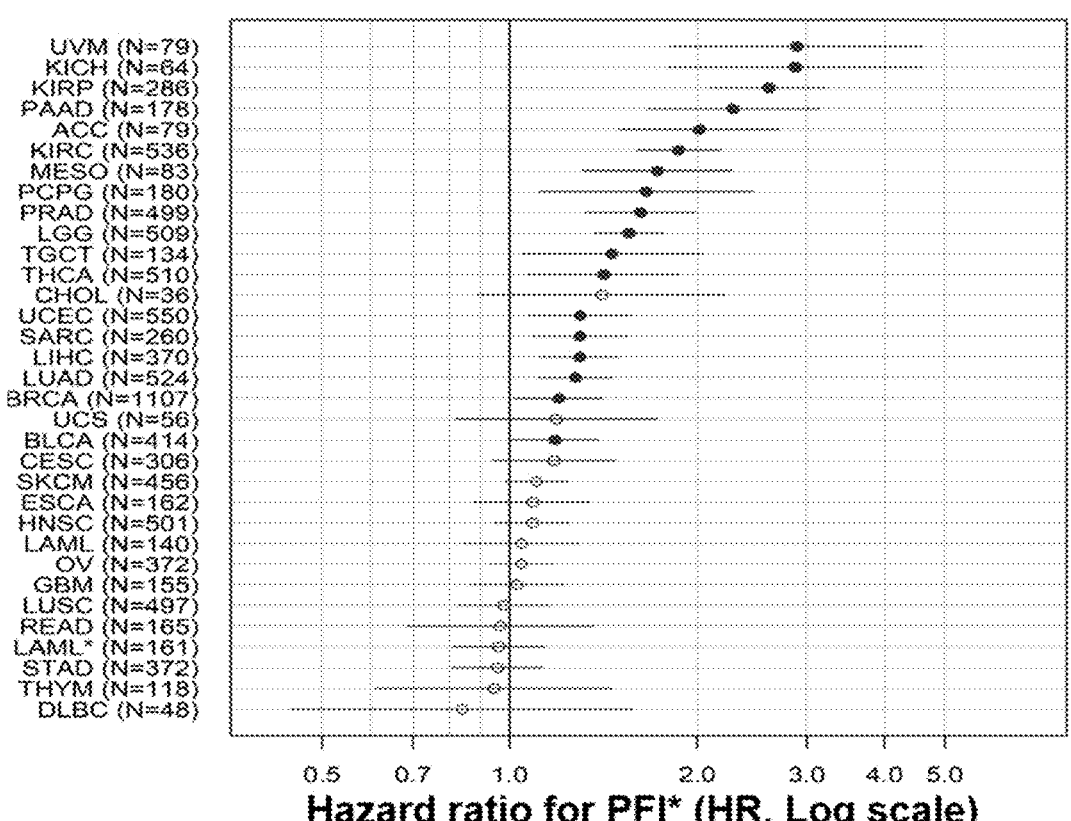
FIG. 44 Effect of the CD10 signature score on survival outcome for each type of cancer of the TCGA Pan-Cancer atlas estimated by hazard ratios of progression-free survival (for LAML where overall survival was used) corresponding to one standard deviation of the CD10 signature score taken as a continuous variable.
Figure 45:
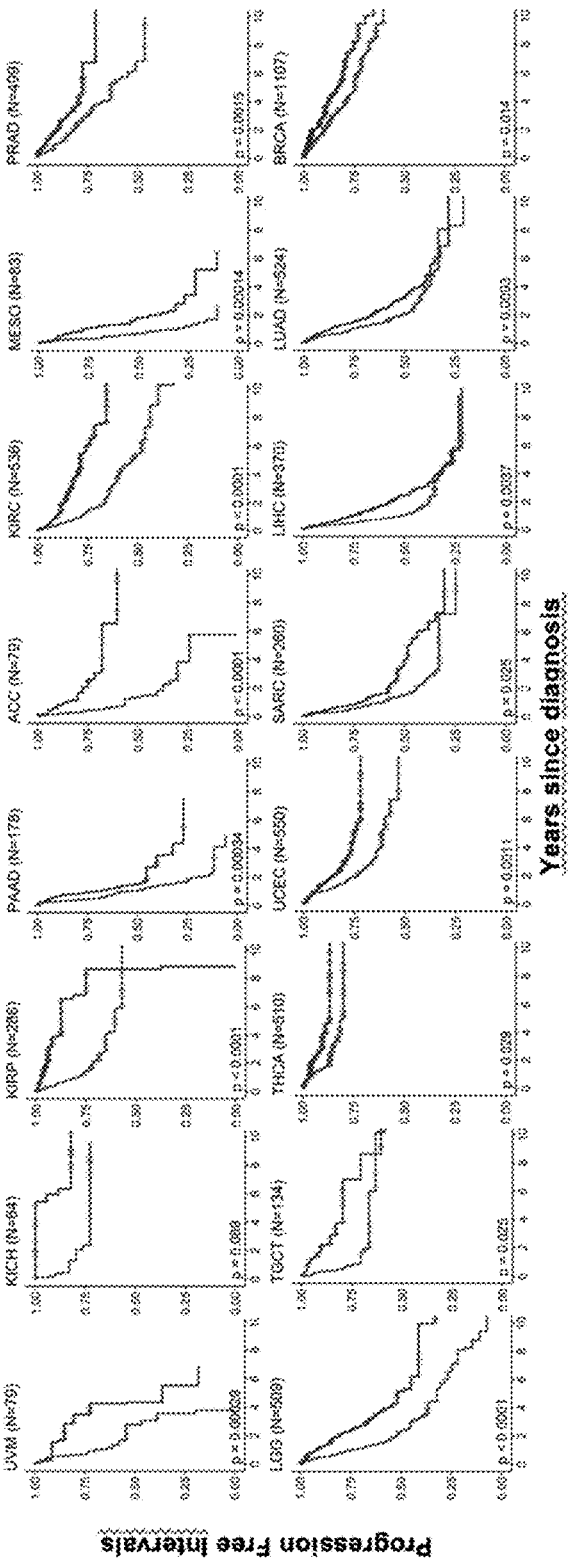
FIG. 45 Progression-free survival curves from the TCGA Pan-Cancer atlas estimated using the Kaplan-Meier method and compared with the Log-Rank test between groups of patients defined by the median of the signature enrichment score (low scores in blue and high scores in red). Only cancer types in which the CD10 signature score significantly ($P<0.05$) predicts outcome are shown.

(95% CI: 4.00-6.64) for the tenth decile denoted q10. Remarkably, the HRs adjusted on age at diagnosis were almost identical to unadjusted HRs, and statistical adjustment on disease stage did not reduce or alter the strong risk gradient (the overlap between adjusted CIs and unadjusted HRs punctual estimates indicate there is no significant statistical difference between adjusted and unadjusted estimates). Furthermore, survival analyses by Cox regression models and Kaplan Meier curves identified several cancer types where high levels of CD10 signature expression were associated with poor progression-free intervals (FIGS. 44 and 45), thus supporting the prognostic value of the CD10-score for these cancers, similarly to breast (FIG. 28) and prostate cancer (FIG. 31). In conclusion, our analysis of large cohorts of patients with various cancers clearly demonstrates the importance of the CD10 molecular signature for the identification of patients with a poor prognosis in several cancer types.

Finally, the inventors have evaluated the relevance of the CD10 signature on the prediction of survival according to the grade of cancers, according to the stage of cancer, or using both criteria.

Figure 54:
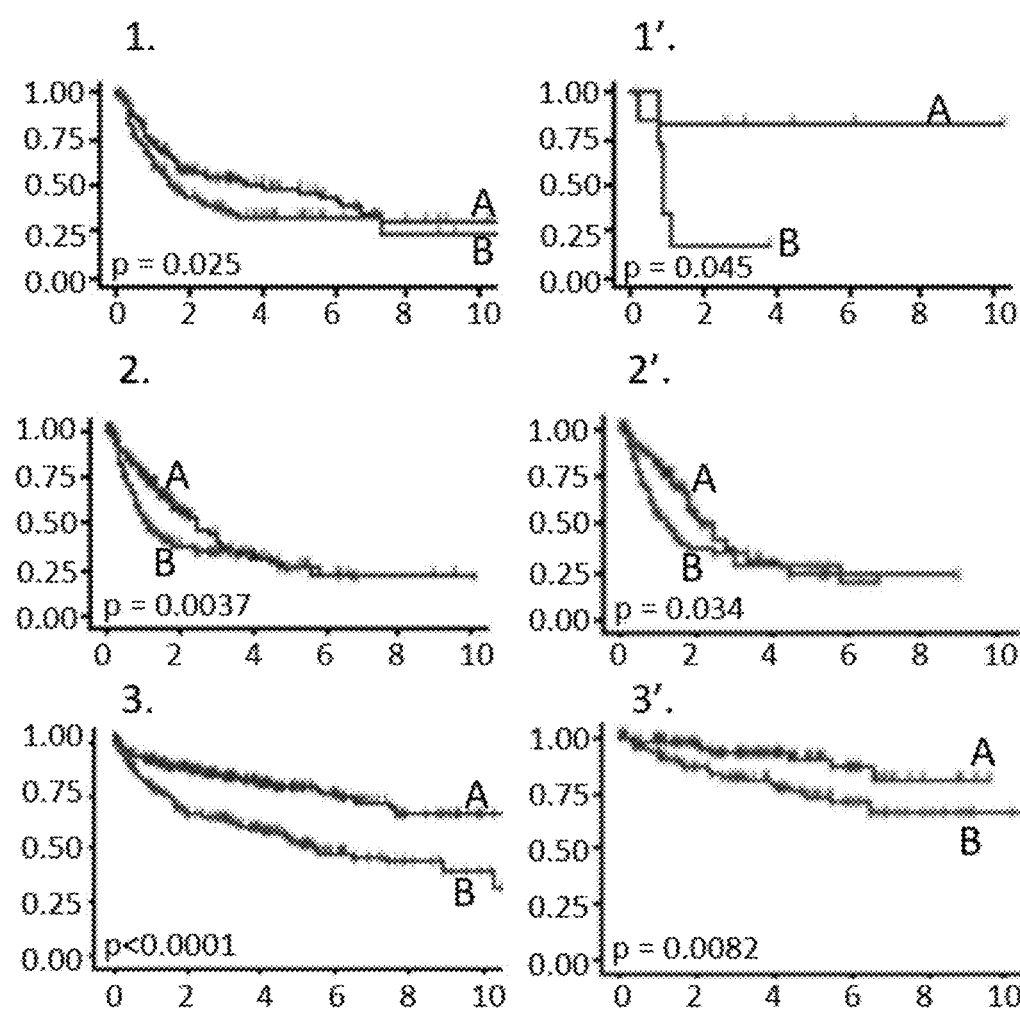
FIG. 54 Progression-free survival curves of Sarcoma (SARC-1; 1'), Liver Hepatocellular Carcinoma (LIHC-2; 2') and Kidney renal clear cell carcinoma (KIRC-3; 3') from the TCGA Pan-Cancer atlas (total cohort on the left column and early grade patients on the right column) estimated using the Kaplan-Meier method and compared with the Log-Rank test between groups of patients defined by the median of the signature enrichment score (low scores A and high scores B).

As shown in FIG. 54, the CD10 signature is significant to determine the prognosis of outcome even in early grades as illustrated in sarcomas, Liver hepatocellular carcinoma and Kidney renal clear cell carcinoma.

In FIG. 55, it is shown that CD10 signature allows to establish the outcome of a tumor whatsoever its stage as illustrated in breast cancer (BRCA), mesothelioma (MESO), Adenoid Cystic Carcinoma (ACC) and Lung Adenocarcinoma (LUAD).

Finally, the inventors shown that in pancreatic adenocarcinoma samples, it possible to determine the outcome using the CD10 signature, at all stages and grades (FIG. 56), Discussion In still too many cases, cancer cells escape treatment either upfront or following drug administration, currently constituting a major challenge to achieve their eradication. Identifying mechanisms involved in tumor escape is of crucial importance from a clinical perspective. The discovery of intra-tumor heterogeneity has profoundly changed the field of oncology leading to new concepts and hypotheses such as the existence of CSCs, cancer cell plasticity, cancer cell reprogramming and clonal hierarchy as major examples. However, despite extensive research, the general mechanisms and processes underlying tumor resistance and progression are still to be formally identified. In that context, identification, localization and tracking of the resistant cancer cells as early as possible remains a major issue as they impair our ability to predict response to treatment and to monitor minimal residual disease to prevent relapse.

Due to the prevalence of the CD10 molecule in association with stem cell features, cancer and drug resistance in many tissues and organs, the inventors investigated whether CD10 could be a useful tool to identify and monitor resistant cancer cells, providing an insight into tumor escape mechanisms. Using a new model of breast cancer derived from an immature MCF10A cell line, the inventors showed that CD10 expression, as for normal primary tissue, is linked to stem cell-like properties in transformed cells. Indeed, modulation of the CD10 protein cell surface expression resulted in the loss of immature properties in these cancer cells. In addition, the accumulation of CD10 at the cell membrane together with an increase in CD10-positive transformed cells were correlated with tumor aggressiveness and progression in our new model of breast cancer. This is consistent with previous data reported not only in breast cancer but also in prostate cancer, melanoma, lung or head and neck squamous cell carcinoma. This indicates that CD10-expressing cells share common features with stem cells both in their normal and transformed state. This is reinforced by the ability of CD10-positive cancer cells to generate CD10-negative cells, and not the opposite, as the inventors have shown here in the model of breast and prostate cancer cells. However, in ovarian cancer CD10-negative cells were also reported to be associated with CSC features, dampening the temptation of considering CD10 cell membrane expression as a good and universal CSC marker. In addition, when the inventors evaluated the potential direct role of CD10 in cell transformation the inventors did not observed any significant effects of modulating protein expression in MCF10A-derived breast cancer models on their transforming properties. Hence, in this context, CD10 expression by itself is not sufficient to drive or maintain a transformed state. Importantly, CD10 expression is not only restricted to cancer cells but is also present in stromal and immune non-transformed cells contained in tumors and contributes to their evolution. Recently, CD10-expressing stromal cells were also shown to provide a surviving niche for CSCs promoting their chemoresistance through the maintenance of their stemness state. These different observations suggest that non-transformed surrounding CD10-expressing cells could also contribute to different aspects of tumor biology and to its heterogeneity. Our data, together with large sets of published observations on CD10, imply that the presence of CD10 in both transformed and non-transformed cells accompanies each step of the transformation process rather than being a driver of transformation itself.

At the mechanistic level, CD10 was reported to display multiple biological effects due to its enzymatic activity that modulates substrates (such as FGF, Bombesin, β-Ameloid, ocytosin) or by direct interaction of its cytoplasmic domain with a variety of proteins (such as ezrin/radixin/moesin proteins, Lyn kinase, and PTEN). At the intrinsic level, CD10 was shown to recruit endogenous PTEN at the cell membrane sustaining its phosphatase activity and protein stability, altogether repressing Akt activity and increasing cell resistance. In our new progressive breast cancer model, that mimics early steps of luminal tumors and generated by chronic exposure of MCF10A stem cell model to high levels of exogenous BMP2, the inventors observed increasing levels of CD10. Reciprocally, in melanoma cells, overexpression of CD10 was linked with an increase in BMP2 production, tumor progression and drug response. The importance of BMP2 dysregulation at both very early and late stages of cancer development and its link to stem cell biology was observed in different types of cancer. These findings suggest a functional link between CD10 expression and BMP2 production, especially at early stages of stem cell transformation. Overall, numerous experimental and clinical observations argue in favor of a role for CD10 in cell transformation processes that can be direct or indirect depending on the specific tissue in which the tumor emerges and evolves.

Altogether, these data raised an apparent contradiction between the increased expression of CD10 in transformed cells with stem cell properties and the lack of effect of its intrinsic expression on transforming parameters. This could be linked to the long-lasting confusion regarding the importance of CD10 from a clinical perspective to predict tumor progression and clinical output. In some tumors, a decrease in CD10 has been associated with increased cell migration, cell growth, and cell survival, contributing to neoplastic development and progression. Inversely, an increased CD10 level has also been associated with cancer progression, invasion and resistance. This unclear role of CD10 is also evidenced when evaluating the correlation between its expression and response to treatment in different conditions. For instance, CD10 expression has been associated in ovarian cancer with cell sensitivity to cisplatin and androgen-sensitive prostate cancer cells, while CD10-positive cells represent more resistant cells in breast cancer, melanoma, and head and neck squamous carcinoma. These contradictory values likely reflect the quantification methods (RNA or protein detection) but more importantly the variability in cells that express CD10 within a tumor, including non-transformed stromal and immune cells. In that context, using an Affymetrix microarray analysis of our breast epithelial model, the inventors identified a CD10-positive immature cell-specific signature that contained 160 genes. The inventors observed that this molecular signature derived from CD10-expressing normal stem cells is high in primary breast tumors and is correlated with aggressiveness of breast cancer subtypes. This suggests that the CD10-score is primarily related to immaturity and plastic status of the cell rather than being specific to a transformed state. Interestingly, the inventors showed that the correlation between the CD10-molecular signature and the cell membrane expression is lost after transformation. This could be indicative of a subpopulation of CD10-expressing cells more prone to transformation. The inventors observed very similar data in the context of prostate cancer despite an initial lower CD10-score in the different prostate cancer subtypes. In both cases tumors with a high CD10-score were predictive of poor patient outcome. Remarkably, when the inventors evaluated the CD10-score in various solid tumors (more than 10,000 tumor samples from 33 cancer types) using the Pan-Cancer database, the inventors recurrently observed a significant enrichment in CD10-molecular signature in tumor tissues compared to paired healthy tissue regardless of the initial CD10-score level. Moreover a strong risk gradient was observed in a pan-cancer Cox model stratified on cancer type and adjusted on both disease stage and age at diagnosis, highlighting a remarkable dose-response relationship of the effect of the CD10-score on survival outcome. The strength of this signature likely resides in the fact that it was identified based on expression and functional properties of CD10 rather than on classical strategies relying on putative CSC-sorted tumor cells to search for their molecular identity. The CD10-molecular signature thus appears to be unique, powerful and highly robust to help predict cancer evolution in many different cancer types.

Lastly, since CD10, and more generally the tumor microenvironment, is also important in the context of drug resistance, the inventors evaluated whether the CD10-score could be predictive of response to treatment. Using the Cancer Cell Line Encyclopedia the inventors observed that the CD10-score was correlated with drug response, either indicative of resistance or inversely of sensitivity, depending on the drug. Interestingly, analysis of the CD10-signature in invasive breast cancer treated with taxane-anthracycline chemotherapy in the neoadjuvant setting revealed that, in this case, the CD10-score could be associated with good response. This surprising observation could be explained by the fact that anthracyclines have previously been shown in leukemia model to efficiently decrease the CD10 population. This has been more recently observed in a breast cancer cohort for which anthracycline neoadjuvant treatment significantly decreased the level of CD10-positive stromal cells and was correlated with a complete or partial clinical response. Targeting the CD10 enzymatic activity could also constitute an interesting therapeutic strategy, as CD10 cleaved drugs have shown some encouraging preliminary results and might constitute a potential differentiation unlock target.

In summary, the inventors identified a novel molecular signature linked to the CD10 function on stem cell maintenance and representative of transformed cells with stem cells properties despite the fact that CD10 itself does not drive cell transformation. Altogether, our analyses strongly indicate that the CD10-molecular signature is linked to cancer evolution and patient survival and may also contribute to identifying efficient therapies in patients in a broad range of cancers.

SEQUENCE LISTING (160 sequences)

SEQ ID NO: 1 - DNA, 2370 bp, Homo sapiens
gagggctgtcgagtccgagcgccgccatggctctgctgtccgagggcctggacgaggtgcccgccgcctgcctgtcgccgtgcgggccgcccaacccgaccgagctgttcagcgagtcacggcgcctggctctggaggagctggtggcgggcggccccgaagccttcgcggccttcctgcgacgcgagcgcctggctcgtttcctgaaccccgatgaggtgcacgccattctgcgcgcggcggagaggccgggagaggagggcgcggcggcggcggcggcggccgaggactcgttcggctcctcgcacgactgctcttcgggcacctacttccccgagcagtcggacctggagccaccgctgttggagcttggctggcccgccttctaccagggcgcctaccgcggcgccacgcgtgtcgagacgcacttccagccccgcggcgctggcgaaggtggcccctacggctgcaaggacgctctgcgccagcagctccgctcggcgcgagaggtgattgcagtggtcatggacgtgttcacagacatcgacatcttcagagacctgcaagaaatatgcaggaaacagggagttgctgtgtatatccttctggaccaggctctcctctctcaatttctggatatgtgcatggatctgaaagttcatcctgaacaggaaaagttaatgacagttcggactatcacaggaaatatctactatgcaaggtcaggaactaagattattgggaaggttcacgaaaagttcacgttgattgatggcatccgcgtggcaacaggctcctacagttttacatggacggatggcaaattaaacagcagtaacttggtaattctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactcccaggaaggcggacctggacccagagatgcccgcagagggcaaggcagagcgcaagccccatgactgtgagtcctctactgttagtgaggaagactacttcagcagccacagggacgagctccagagcagaaaggccattgacgctgccactcaaacagagccaggagaggagatgccagggctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgctttaaaaaatatcttatgtccctaattgcctttcttttacctgactttgtcacctttgttgtctttgaattctttaggctgcatattattttacatgctttgttttgtcatgtatataccaggtattggttttatggtttaaacactatggatacaggggtttgttttgcacaattttaatagtcatgcactacataatgatgttttggtcaatgacagaccacgtatatgttggcagtctcataagattataatactgtatttttactataccttttctgtgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgtttatctctttagaatatctgtgttcttagcattaaataaatataaacttgtgcttctgta

SEQ ID NO: 2 - DNA, 2966 bp, Homo sapiens
caaacgtgtttgcggaaaggagtttgggttccatcttttcatttccccagcgcagctttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaatctaagagaaagtcagagtgtattaaccagaatcctgctgcatcttcaaatcactggcagattccggagttagcccgaaaagttaatacagagcagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccatattaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccatatgttcaaattcaaactcatccagttaaccaaatggccaagggaaccactgaagaaatgaaatatgttctgggccaacttgttggtctgaattctcctaactccattttgaaagctgctaaaactttatatgaacactatagtggtggtgaaagtcataattcttcatcctccaagacttttgaaaaaaaaaggggaaaaaaatgatttgcagttattcgtaatgtcagataccacctataaaatatattggactgttatactcttgaatccctgtggaaatctacatttgaagacaacatcactctgaagtgttatcagcaaaaaaaattcagtagattatctttaaaagaaaactgtaaaaatagcaaccacttatggcactgtatatattgtagacttgttttctctgttttatgctcttgtgtaatctacttgacatcattttactcttggaatagtgggtggatagcaagtatattctaaaaaactttgtaaataaagttttgtggctaaaatgacactaacattt

SEQ ID NO: 3 - DNA, 838 bp, Homo sapiens
agactgagcccaggttgatttcaggcggacaccaatagactccacagcagctccaggagcccagacaccggcggccagaagcaaggctaggagctgctgcagccatgtcggccctcagcctcctcattctgggcctgctcacggcagtgccacctgccagctgtcagcaaggcctggggaaccttcagccctggatgcagggccttatcgcggtggccgtgttcctggtcctcgttgcaatcgcctttgcagtcaaccacttctggtgccaggaggagccggagcctgcacacatgatcctgaccgtcggaaacaaggcagatggagtcctggtgggaacagatggaaggtactcttcgatggcggccagtttcaggtccagtgagcatgagaatgcctatgagaatgtgcccgaggaggaaggcaaggtccgcagcaccccgatgtaaccttctctgtggctccaaccccaagactcccaggcacatgggatggatgtccagtgctaccacccaagccccctccttctttgtgtggaatctgcaatagtgggctgactccctccagccccatgccggccctacccgcccttgaagtatagccagccaaggttggagctcagaccgtgtctaggttggggctcggctgtggccctggggtctcctgctcagctcagaagagccttctggagaggacagtcagctgagcacctcccatcctgctcacacgtccttccccataactatggaaatggccctaatttctgtgaaataaagactttttgtatttctggggctgaggctcagcaacagcccctcaggcttccagtgagtcccca

SEQ ID NO: 4 - DNA, 1908 bp, Homo sapiens
gtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagtggtgacatcgtctctctcattcatgactgaggaagtgcctgcaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcgtgtgactttcctagataacactgctttctcataataaagactatttgcatttgacatctgttccctttcaccggcaacctccaacctcccccgccctcccacaccactctgggctatagatttgtaatttgtggtttggggtctggccctcatccacctctgctccgagccagtctgcccccaatcccaccccagggagaacatgtagaaagggaaaggtttctcaacttagttcagaccaaaacacattgtaaaggcaaagaaggtttttatttaagtgacaacatttgagagctaaaaaccagctcacatcaaaatcaagacccagttgtaaaaatcttttaactccataatgctgtttttgtcttgttagaaatctgatatcttacattagcgtttctaacggattttgtacaaggcagccataaggaatataataaacctttttcaccacagaa

SEQ ID NO: 5 - DNA, 3902 bp, Homo sapiens
gcgcaggagaccccgggtgacggggcccggcgccgctaactggagcgaaccccagcgtccgccgacatggcctggaccaagtaccagctgttcctggccgggctcatgcttgttaccggctccatcaacacgctctcggcaaaatgggcggacaatttcatggccgagggctgtggagggagcaaggagcacagcttccagcatcccttcctccaggcagtgggcatgttcctgggagaattctcctgcctggctgccttctacctcctccgatgcagagctgcagggcaatcagactccagcgtagacccccagcagcccttcaaccctcttcttttcctgcccccagcgctctgtgacatgacagggaccagcctcatgtatgtggctctgaacatgaccagtgcctccagcttccagatgctgcggggtgcagtgatcatattcactggcctgttctcggtggccttcctgggccggaggctggtgctgagccagtggctgggcatcctagccaccatcgcggggctggtggtcgtgggcctggctgacctcctgagcaagcacgacagtcagcacaagctcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtgatcctctccctgctgctggtgcccatgtactacatccccgccggctccttcagcggaaaccctcgtgggacactggaggatgcattggacgccttctgccaggtgggccagcagccgctcattgccgtggcactgctgggcaacatcagcagcattgccttcttcaacttcgcaggcatcagcgtcaccaaggaactgagcgccaccacccgcatggtgttggacagcttgcgcaccgttgtcatctgggcactgagcctggcactgggctgggaggccttccatgcactgcagatccttggcttcctcatactccttataggcactgccctctacaatgggctacaccgtccgctgctgggccgcctgtccaggggccggcccctggcagaggagagcgagcaggagagactgctgggtggcacccgcactcccatcaatgatgccagctgaggttccctggaggcttctactgccacccgggtgctccttctccctgagactgaggccacacaggctggtgggccccgaatgccctatccccaaggcctcaccctgtcccctccctgcagaacccccagggcagctgctgccacagaagataacaacacccaagtcctctttttctcactaccacctgcagggtggtgttacccagcccccacaagcctgagtgcagtggcagacctcagctctctggacccctcctacagcactagagctaaatcatgaagttgaattgtaggaatttaccaccgtagtgtatctgaatcataaactagattatcatagttatctagtttatgagtcataagctagatttgattcttcaaagaagaaaagtcagtgagcaaatttaaaccagaactaagcattatattttctttttttttttttgagacagagtctcgctctgtcgcccaggctggagtgcagtggcacgatctcggcggctcactacaacctctgcctcccaggttcaaatgattctcctgcctcagcctcccgagtagctgggattacaggtgcataacacacctgggtaacttttatagagatggggtttcaccatgttggccaggctggtctcaaactcctgacctcaggtgatctgcctgcctcggcctcccaaagtgctgggattacaggcgtgagacaccacacccagccataactaagcattatgttttctaaaacttctaagatcctccctaaacccgtctggagacatgggttttagcccagactctgcctcaaactcattgtagctcccagcacattacccagttgctctgggccttggtgttatgctctgggaagtagatgttgatgctgtggccttagtgccttctggccccagcattccatgggcctgtgatcttgaccaacctgagaaaacagtaacagcccatccactggaaatacccctctgcccacagcaccacccttctgtgctgttttttttgttgtttgtttgtttcttctttttgagacagagtcttgctctgttgccacgctggagtgcagtggtgtgatctcggctcactgcaacctcccgctcccaggttcaagcaagtcccctgagtagctgggactacaggcgtgtgccaccacatccggctaattttttgcattctttaatagagacggggttttgccatgttggccaggatggtctcaatctcctgacctcatgatccacctgcctcagcctcccaaagtgctggggttacaggcatgagccaccacgcccagccttttttttttttttttttttttcttgagagacagggtcttgctctgtcacccaggcacagcttactgcagccttgaactcctgggatcaatcagtcctcctgcctcagcctcccgagtagctaagactaacaggtatgtaccaccatgcctggtttattgttttatttttttggcagagatgggtctcactgtgttgcccaggctgatctcaaactcctggcctcaagcgatcctcccatctcagcctcccaaagtgctgggattacagacctgagccaccacacctgggcaacagagtgaaacctgtccctgttttcctgctcttactctcacctctgaggcctcctctgcctggaagagattacagggaaattccaggcagcccttgtcaattgtttttatgaattctttacctgttccttttaaagacaaggaaactgaggcccaaagttctaagttgtttggcaaatggagtctcctaccctcagctcctgcaaggacctgggggacccccaggtccagcagccacatgattctgcagcagacagggacctagagcacatctggatctcagccccacccctggcaacctgcctgcctagagaactcccaagatgacagactaagtaggattctgccatttagaataattctggtatcctgggcgttgcgttaagttgcttaactttcattctgtcttacgatagtcttcagaggtgggaacagatgaagaaaccatgccccagagaaggttaagtgacttcctctttatggagccagtgttccaacctaggtttgcctgataccagacctgtggccccacctcccatgcaggtctctgtggggtctttgggatggatctcctagggctgggctggaagcctcatgtactgttgtcttctaggtaaccaccctgaagagaaggggtggcatcaggaaccgcagggaaccaagcagcctttggtccagtgctgctccttggaacagttgagtgtggcctcaaaccattctcctgggtagctcagtcataaaacaccgaatgcctgcctcaaaatagcctctgagggaagggagctgttgacaagtgaagccctcaggttgtgtgggattccagcaggttattacagcttgtggggggagggagggtccattccaccagctttgaatcccagggtcccctcagcttcactgggccacagtgtctgtcccaggaagaagcaaatggacagtgaggatgatggagagactacagctgccttgtctaaaacctgggatcttaaaagtgttattttggcttttattttttaaaaaaagaaaaggaaaattggcaattgtattaatccattctcgaattgctgtaaagaaatacctgagactgggtaatttaatttataaagaaaagaggtttaattggc

SEQ ID NO: 6 - DNA, 2263 bp, Homo sapiens
gtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtca

SEQ ID NO: 7 - DNA, 3636 bp, Homo sapiens
ggcgccctgaaacgttcggcgagccgactgcggctgcgcggggtattcgaatcggcggcggcttctagtttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaacttagttgttataaatatttcaacaaaatatacaaccccataaggtccctatatagcaggctgattgggctgcttctgggatgcaagcatttgtgagaataattcagacatgagcattctctagaaatcacttt

SEQ ID NO: 8 - DNA, 2881 bp, Homo sapiens
aagtttgaatttcgtggaggctcgggttgtgagggttcctgcttcggagtcggcggtggtcgtccagaccgagtgttctttactttttgtttggttgaggtttcacgctagaaggtggctcaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattcctttgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaatcatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcaccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtg

SEQ ID NO: 9 - DNA, 3072 bp, Homo sapiens
aacggctcgcggagcggctacgcggagtgacatcgccggtgtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagcattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgaaggatccgtccctctctgacagttccactgttgggcttcagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaa

SEQ ID NO: 10 - DNA, 4478 bp, Homo sapiens
gccgagctcccggagctgggtgggggtgccccacgctgaaagagagtgatggagtgcccagtgatggaaactggctcactttttacctcaggaattaagagacatttgaaagacaaaagaatttcaaagactactaagttgaatgtttctcttgcttcaaaaataaaaacaaaaatactaaataattcttctattttcaaaatatctttaaagcacaacaacagggcattagctcaggctcttagtagagaaaaagagaattctcgaagaattacaactgaaaagatgctattgcaaaaagaagtagagaaactgaattttgagaacacatttcttcgcctaaagctaaataacttgaataagaagcttatagacatagaagctctcatgaacaataacttgataactgcaattgaaatgagcagtctttctgagttccatcagagttcctttctactgtcagctagcaagaagaaacgaattagtaaacagtgcaagttgatgcgtcttccatttgcaagggttccattaacttcaaatgatgatgaagatgaagataaagagaaaatgcagtgtgacaacaatattaaatcaaagacattacctgatattccctcttcaggatcaacaacacaacctttatcaactcaggataattcggaagtgttatttcttaaagaaaataatcaaaatgtatatggtttagatgattcagaacatatttcttctatagttgatgtacctcccagagaaagccattcccactcagaccaaagttctaagacttctctaatgagtgagatgagaaacgcccagtctattggccgcagatgggagaaaccatctcctagtaatgtgactgaaaggaagaagcgtgggtcatcttgggaatcaaataatctttctgcagacactccctgtgcaacagttttagataaacaacacatttcaagtccagaattaaattgcaataatgagataaatggtcatactaatgaaacaaatactgaaatgcaaagaaataaacaggatcttcctggcttatcttctgagtctgccagagaacctaatgcagagtgcatgaatcaaattgaggataatgatgactttcaattgcagaaaactgtgtatgatgctgacatggatttaactgctagtgaagtcagcaaaattgtcacagtctcaacaggcattaaaaagaaaagtaataaaaaaacaaatgaacatggaatgaaaactttcagaaaagtgaaagattccagctctgaaaaaaagagagaaagatcaaagagacagtttaaaaatagttcagatgtcgatattggggaaaagattgaaaacaggacagaaagatctgatgtcctggatggcaaaaggggtgcagaagatcccggttttattttcaataatgaacagctggctcagatgaatgaacagctggctcaggtgaatgaactaaagaaaatgacccttcaaactggctttgaacaaggtgacagagaaaatgtactgtgtaataaaaaggagaaaagaataacaaatgagcaagaggaaacatactctttatcccaaagttcaggtaaatttcaccaggagagtaaatttgataagggtcagaattccctaacttgtaataaaagtaaagcttctagacagacatttgtgattcacaaattagaaaaagataacttactcccaaaccaaaaggataaagtaaccatttatgaaaacctagacgtcacaaatgaatttcacacagccaatctttccaccaaagataatggaaatttatgtgattatgggacccacaatatattggatttgaaaaagtatgtcactgatattcaaccctcagagcaaaatgaatcaaacattaataagcttagaaagaaagtaaaccggaagacagaaataatttctggaatgaaccacatgtatgaggataatgataaagatgtggtgcatggcctaaaaaaaggtaatttttttttcaaaacccaagaggataaagaacctatctctgaaaacatagaagtttccaaagagcttcaaatcccagctctttctactagagataatgaaaatcaatgtgactataggacccagaatgtgttgggtttgcaaaagcagatcaccaatatgtaccccgttcagcaaaatgaatcaaaagttaataagaagcttaggcagaaagtaaatcggaagacagaaataatttctgaagtgaatcatttagataatgacaaaagtatagaatacacagttaaaagtcactcactctttttaacgcaaaaagataaggaaatcatccctggaaacctagaagacccaagtgagtttgaaacacctgctctttctaccaaagatagtggaaacctgtatgattctgagattcaaaatgttttgggggtgaaacatggccatgatatgcaacctgcttgtcaaaatgattcaaaaataggtaagaagcctagactaaatgtatgtcaaaagtcagaaataattcctgaaaccaaccaaatatatgagaatgataacaaaggtgtacatgacctagaaaaagataacttcttctctctaaccccaaaggataaagaaacaatttctgaaaatctacaagtcacaaatgaatttcaaacagttgatcttctcatcaaagataatggaaatttatgtgattatgacacccagaatatattggagttgaaaaagtatgttactgataggaaatctgctgagcaaaatgaatcaaaaataaataagctcaggaataaagtgaattggaagacagaaataatttctgaaatgaaccagatatatgaggataatgataaagatgcacatgtccaagaaagctatacaaaagatcttgattttaaagtaaataaatctaaacaaaaacttgaatgccaagacattatcaataaacactatatggaagtcaacagtaatgaaaaggaaagttgtgatcaaattttagattcctacaaagtagttaaaaaacgtaagaaagaatcatcatgcaaggcaaagaacattttgacaaaagctaagaacaaacttgcttcacagttaacagaatcttcacagacatctatctccttagaatctgatttaaaacatattactagtgaagcagattctgatccaggaaacccagttgaactatgtaagactcagaagcaaagcactaccactttgaataaaaaagatctcccttttgtggaagaaataaaagaaggagagtgtcaggttaaaaaggtaaataaaatgacatctaagtcaaagaaaaggaagacctccatagatccttctccagagagccatgaagtaatggaaagaatacttgacagcgttcagggaaagtctactgtatctgaacaagctgataaggaaaacaatttggagaatgagaaaatggtcaaaaataagccagacttttacacaaaggcatttagatctttgtctgagatacattcacctaacatacaagattcttcctttgacagtgttcgtgaaggtttagtacctttgagcgtttcttctggtaaaaatgtgataataaaagaaaattttgccttggagtgctccccagcctttcaagtaagtgatgatgagcatgagaagatgaacaagatgaaatttaaagtcaaccggagaacccaaaaatcaggaataggtgatagaccattacaggacttgtcaaataccagttttgtttcaaataacactgctgaatctgaaaataagtcagaagatctatcttcagaacggacaagcagaagaagaaggtgtactcctttctattttaaagagccaagcctcagagacaagatgagaagatgaagtgaatttatggattctggtttttctgaattttcaaagcataaggaatcaaaacagaaatatagtatcaagaagatgaaatgcttaatgaaaaggttttttttttgtttctttggcctttcatggagtgttgatttgtccattcttaatgtttattaataggtatatgtgcataaaatagctattttgtaacattaaactttttgagtcattttggtcatcatataacttaccttcctgtttatttaagcttctttttacctagtagcctttaaccaaacaataaccttttaaccaaataaaatgtgttaataaatacctttgcattggttatcttgtatactaggctgtcttgttttgctgtctgtttttaacccattcaatatatgtggacatccaaaagggtttaaaagccacctcctgccctggcccgttttctctcccttcattcttctgttttcagaaatacatgttgaatgtcagcttctgtattatttctattatatgtaatctgatgacttagaggaggagattaacctttcaggctcttttgaatttggtttttataatttggttttaaagatcacttactcttccagtaataagtagtaataaatcctgttcatatctga

SEQ ID NO: 11 - DNA, 2093 bp, Homo sapiens
attcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgaga

SEQ ID NO: 12 - DNA, 2259 bp, Homo sapiens
cgataaagcccccgccgccgcggcagccagcttgcgctgtggggctgcccgggctgcgcggcgtctgcaggcgccaccgctgcctctttccggctgtgaccctcctcgccgccgccgcttggctgcgtcctccgactccccgcgccgccgagaccaggctcccgctccggttgcggccgcaccgccctccgcggccgccccctggggatccagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaacagggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttgggggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaatacaatagaagaaactgagccttttagacattcgtcagcctcttctaataaacctttgtactatgtaaacatcaggaaattc

SEQ ID NO: 13 - DNA, 4928 bp, Homo sapiens
actcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatggggtttgctgtttggatcaaggaatcaatggattgccagaatttgaggaaggaagtaagacaagtccaaaactcttcgcagaagaggagtttctgccattggatccaacccaggaactgatatttcctcctgagctaatgataatggctgagaaacagtcgcaaaggaccagggtgtttggcagtgagagaatgatgtggttttcccccgtgaccctgaaggaactgctggaatttaaattcaagtatccccaggctcctgttatcatgggaaacacctctgtggggcctgaagtgaaatttaaaggcgtctttcacccagttataatttctcctgatagaattgaagaactgagtgttgtaaaccatgcatataatggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggcttctttagggggacacatcattagcaggcatccagattcagatctgaatcccatcctggctgtgggtaactgtaccctcaacttgctatcaaaagaaggaaaacgacagattcctttaaatgagcaattcctcagcaagtgccctaatgcagatcttaagcctcaagaaatcttggtctcagtgaacatcccctactcaaggaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggctgctgccttggttcacatttatcttgatggctctgtgctggtcactcacggtggaattgaaatggggcagggggtccacactaaaatgattcaggtggtcagccgtgaattaagaatgccaatgtcgaatgtccacctgcgtggaacaagcacagaaactgtccctaatgcaaatatctctggaggttctgtggtggcagatctcaacggtttggcagtaaaggatgcctgtcaaactcttctaaaacgcctcgaacccatcatcagcaagaatcctaaaggaacttggaaagactgggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatatccgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaa

SEQ ID NO: 14 - DNA, 2475 bp, Homo sapiens
cttcccggttggcgcgcgcccggggcggcggcgctggaggagctcgagacggagcctaagttatgtctgggaggcgaacgcggtccggaggagccgctcagcgctccgggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggatttcctttttcttggagaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccaggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttgaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccaggggctctgccagcctcggcctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgttca

SEQ ID NO: 15 - DNA, 1923 bp, Homo sapiens
agcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaaataaaaaaaaaaaa

SEQ ID NO: 16 - DNA, 1619 bp, Homo sapiens
cttcttaagcagcctgtggccgggcacagtagctcacacctgtaatcccagcactttggaaggccgaggtgggcggatcacctgagctcaggagtttgagaccagcctgtctctactaacaatataaaaattagctgggagtcacggtgggcgcctgtaatcccagctactcgggaggctgaggcaggagaattgcttgaacccaggagacagaggttgtagtgagctgagatcgcaccactgcactctagccttggcaacagtgcaagactgtctcaaaaacagcaacagagagcaggacgtgagacttctacctgctcactcagaatcatttctgcaccaaccatggccacgtttgtggagctcagtaccaaagccaagatgcccattgtgggcctgggcacttggaagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcaatgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgaggatgtaaagatcaataaaaaaaataataatcataaccaa

SEQ ID NO: 17 - DNA, 5299 bp, Homo sapiens
gtgccgagactcgccactgccgcggccgctgggcctgagtgtcgccttcgccgccatggacgccaccgggcgctgacagacctatggagagtcagggtgtgcctcccgggccttatcgggccaccaagctgtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcagatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaataatccaacttatgttggatttgaacgagatgtattcagaacaatcgcagattattttctagatctccctgaacctctacttacttttgaatattacgaattatttgtaaacattttggttgtttgtggctacatcacagtttcagatagatccagtgggatacataaaattcaagatgatccacagtcttcaaaattccttcacttaaacaatttgaattccttcaaatcaactgagtgccttcttctcagtctgcttcatagagaaaaaaacaaagaagaatcagattctactgagagactacagataagcaatccaggatttcaagaaagatgtgctaagaaaatgcagctagttaatttaagaaacagaagagtgagtgctaatgacataatgggaggaagttgtcataatttaatagggttaagtaatatgcatgatctatcctctaacagcaaaccaaggtgctgttctttggaaggaattgtagatgtgccagggaattcaagtaaagaggcatccagtgtctttcatcaatcttttccgaacatagaaggacaaaataataaactgtttttagagtctaagcccaaacaggaattcctgttgaatcttcattcagaggaaaatattcaaaagccattcagtgctggttttaagagaacctctactttgactgttcaagaccaagaggagttgtgtaatgggaaatgcaagtcaaaacagctttgtaggtctcagagtttgcttttaagaagtagtacaagaaggaatagttatatcaatacaccagtggctgaaattatcatgaaaccaaatgttggacaaggcagcacaagtgtgcaaacagctatggaaagtgaactcggagagtctagtgccacaatcaataaaagactctgcaaaagtacaatagaactttcagaaaattctttacttccagcttcttctatgttgactggcacacaaagcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacagtttcagaaggaatatcctttgatatatcagaaaagatttccaaccacggagagtgaagcagcactttttggtgacaaacctacaatcaagcaaccaatgctgattttaagaaaaccaaagttccgtagtctaagataactaactgaattaaaaattatgtaatacttgtggaactttgataaatgaagccatatctgagaatgtagctactcaaaaggaagtctgtcattaataaggtatttctaaataaacacattatgtaaggaagtgccaaaatagttatcaatgtgagactcttaggaaactaactagatctcaattgagagcacataacaatagatgataccaaatactttttgtttttaacacagctatccagtaaggctatcatgatgtgtgctaaaattttatttacttgaattttgaaaactgagctgtgttagggattaaactataattctgttcttaaaagaaaatttatctgcaaatgtgcaagttctgagatattagctaatgaattagttgtttggggttacttctttgtttctaagtataagaatgtgaagaatatttgaaaactcaatgaaataattctcagctgccaaatgttgcactcttttatatattctttttccacttttgatctatttatatatatgtatgtgtttttaaaatatgtgtatattttatcagatttggttttgccttaaatattatccccaattgcttcagtcattcatttgttcagtatatatattttgaattctagttttcataatctattagaagatggggatataaaagaagtataaggcaatcatatattcattcaaaagatatttatttagcaactgctatgtgcctttcgttgttccagatatgcagagacaatgataaataaaacatataatctcttccataaggtatttattttttaatcaagggagatacacctatcagatgtttaaaataacaacactacccactgaaatcagggcatatagaatcattcagctaaagagtgacttctatgatgatggaacaggtctctaagctagtggttttcaaactggtacacattagactcacccgaggaattttaaaacagcctatatgcccagggcctaacttacactaattaaatctgaattttggggatgttgtatagggattagtattttttttaatctaggtgattccaatattcagccaactgtgagaatcaatggcctaaatgctttttataaacatttttataagtgtcaagataatggcacattgactttattttttcattggaagaaaatgcctgccaagtataaatgactctcatcttaaaacaaggttcttcaggtttctgcttgattgacttggtacaaacttgaagcaagttgccttctaatttttactccaagattgtttcatatctattccttaagtgtaaagaaatatataatgcatggtttgtaataaaatcttaatgtttaatgactgttctcatttctcaatgtaatttcatactgtttctctataaaatgatagtattccatttaacattactgatttttattaaaaacctggacagaaaattataaattataaatatgactttatcctggctataaaattattgaaccaaaatgaattctttctaaggcatttgaatactaaaacgtttattgtttatagatatgtaaaatgtggattatgttgcaaattgagattaaaattatttggggttttgtaacaatataattttgcttttgtattatagacaaatatataaataataaaggcaggcaactttcatttgcactaatgtacatgcaattgagattacaaaatacatggtacaatgctttaataacaaactctgccagtcaggtttgaatcctactgtgctattaactagctagtaaactcagacaagttacttaacttctctaagccccagttttgttatctataaaatgaatattataatagtacctctttttaggattgcgaggattaagcaggataatgcatgtaaagtgttagcacagtgtctcacatagaataagcactctataaatattttactagaatcacctaggattatagcactagaagagatcttagcaaaaatgtggtcctttctgttgctttggacagacatgaaccaaaacaaaattacggacaattgatgagccttattaactatcttttcattatgagacaaaggttctgattatgcctactggttgaaattttttaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagttcttatcccagaaattactgcctccaccatccctaatatcttctaattggtatcatataatgacccactcttcttatgttatccaaacagttatgtggcatttagtaatggaatgtacatggaatttcccactgacttacctttctgtccttgggaagcttaaactctgaatcttctcatctgtaaaatgtgaattaaagtatctacctaactgagttgtgattgtagtgaaagaaaggcaatatatttaaatcttgaatttagcaagcccacgcttgatttttatgtcctttcctcttgccttgtattgagtttaagatctctactgattaaaactcttttgctatcaa

SEQ ID NO: 18 - DNA, 4731 bp, Homo sapiens
gagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccagacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccaaaggttgagcagaaaattgaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaa

SEQ ID NO: 19 - DNA, 2856 bp, Homo sapiens
ctcccagccccctctgtttagatcagggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaaaaaaaaaaaaaaaaaaaaaaaaaaaaaaaa

SEQ ID NO: 20 - DNA, 6827 bp, Homo sapiens
tttaaagaaaggcagccggcgaaaagaggcaagagaggagaagaaagagaaaccaggggggcgaggcgccgtccaatgacaaagcccaggggtgggcgccggccgccatcttgtaccgggcagcaggatattcgcccgcgtcctccgccctcggagggggaggggcggcggcggaggcgagaaaagtagcgagagacgccagcagcagccgccgccgcggagccaacgcggactgggacggcggcggcagtagtgggacccggcgagcgtgagtggcccggagcggccttcgatgcggcgcagtatgaagaggcggcggcgccggcgcccggtcgccccggccacggccgcccggggcggcgactttagggcagaagacggggctgggttggaggcgcgggaggagaaggtggtgtactcgcggtcgcaactgtcgctggctgacagcaccaaggcgctgggcgacgccttcaagctcttcatgccccgcagcacggagttcatgagctcggacgcggagctctggagcttcctctgcagcctcaagcaccagttctccccgcacatcctgcgcagcaaggacgtctacggctactcctcctgccgggccctggtacccgaccccccggggccccctacagcccgcggccaggcgcgccggccggttccgcgcgcagcggccaggaggaggcgccgcggagcccgggcggccgctgcccgcaggaggaagccccggccgccacccccaccgccgccgccccccgaggagagctgcccggccaagcccgtggcccccgggccctgcttcgggggccgcaccttggaggagatctggagggcggccaccccgacgctgaccaccttccccaccatccgcgtcggcagcgacgtgtggggcgagcgcagcctggcggcagcgcggcgcagggcgcgccaggtcctgcgagtgaacctggaacccatggtgaggctccgccgcttcccggtgccccgggcatgaggtgcggcctccagggcgcctcctgccggccccgaccttgggacaggccttccgcccggaggaatgaacaagtgtcagtcgagtgtttacagatccggccaggaccccggcccccaatgcactttacgcgcgaagaagttgccggatggttgtccctgtcccgggccgcggcgcggtcgtcttggacgctggggcaggtgtgccctctgctgcctcccgtacccggcctgcggagggaggggacagctggacccgcaggggaggtccctttcttcctgaccaccgattgagacgtctccaggaccttaggggcagatccgttttctcactgttggactctacctcactggtctggaagtcctccgaagacattatttttccaaaggaatttggtttcgtgcttgtgtaataaagccagaatttacttgttctttatctccccctttttctatttcactgtcacccctctttgtggacagaagttcgaacatgtggtgttgcactagtttgtgctcagggtattctgaagcccactcgtttcctaatttttactggattccaaagctttgatcgaggatattttttaagaggttcaagcttgtgactgttagtagtgcaaggatttgtatgggctcagtgattacaaacaaagacatgcaaaatacaactgtttaaacattttcaaggtatttttaaaggttttgtattgaaacaatgtttatatttactgagctcctaaaaatggtagaatacacatgaaaacttttgtttaggaaaagttaacttgttaaattcttttgaattgaataaaaaaatgcattgaaaccatatggtgtgtgattaaaaaaaatgaataaattgtgaagaactggttttggttacaggagtcactggaatccgactggagatgatttggccccctgtcctggtctaacatacaaatctaggaatattatgcgttaaagtattttaaaatacattatccttgtaatgtattttacaaggataatgtattttaaaatgggagttgcataggagagatggatgtgtgtaaacattatcactaaaatgataaacagaatacccattagaattcttagaactattaatgatcaagaggggtggaggcatttcttggtatcaaataactggttaaggttactttgggcgaaatctatttcctttttgtttttgttgttggataacaagaaatgtctagactaatattcatcagttttacaaacataatgaaaattagttgatttttagttgatttttttgtcccaacattttttttaacctttttgccactcattatatgtttgcagttctaggtctttgacagctgaagaccacaggaatcaaacaggcgagacacacagaatactgacccttctttacgcttttatagtgtttataccatatggcccagtgtggaattcttgattatccaagtgcctttggtcatttgtggcaggaaaacttaatagtttttagccagcagtgccacagccagcttttactgcaatacctaaagggtcaagtagtgtttttgtaccactattatttcaaatttaagtattctgccatgaaacgatccatactgggctggaacttgacatgtgaaatctttaatactaaagcttatctctgcttggcagctttttaggagaataatgagagttacaattttgactcttgcgttcctagaattcaaatggcatagctttctgaaatgagtatttcaagtttagtagtccgtataggagtgttgtgacttcaatttcagtgttcttgttaaaagaaataatatgatatatatatacacacatatatataacttgatgccagttttctagtaagcctcagtcttttattcactactcaatgataatgcattgtacaaacactgtcacatgagtaaataaaaatgaataattccttagaagatggagagtgttaaattatatttgtgataggaagcttagacatatcttttggttattagcttccattgccaattgtatttcagatgcatagggttttcttcccaaaaatatattgttaacttttatagctaactagcacctggaaaaaatgtatttgtacaactttactattgtatatagttttataataatgaaaaataaacccaatggccatattagaatgcaatttcgacatacagcttatctagatagttttccagaggattttgaaatttggcttaactgggaggataactgctcagcacaccactgaaacataaccactgacaccattcatttattttaactgagattcttgacatttttctctcctatgccttgttactttagcatacttgaactcacataaatgcttctttggattacatgggctatctgattccattttggatctgattgtccatcttgaattcaatatggtattcatctggactattcaaaaattatgccatttctagtctgtgaaataagatgtaaaaaatctttatttttgccctttggtaaaaacctatgtgacaacttttaaaatgtgaagcaacatctaatatagttgactggtatactaataggaaagtgaaagtatttcatgggtactttgtcacagaatgtgaaaagaaacttggcatagtggcctttataatgaggcatccacttactcctctgaagtgaagtctgtagcttagcttgtgtatagtttttgaaagaaatctcatgatcttcgttcattctcttgccttctcttttatctcatatggcacaagtagagggggaagccaggaggaaattcatcacctcgctatgcttttatttgatttttaattcctgagtgcctaaatgtggtgaccggcacctcacataactttttgagattcttgatgtcatttttatccttcctgtcaaccagcaatgtatttttatgttactaaaaccagtaacgtcataattgttgagggcaagcttcattgttgatagtgcaaagtgtcgctgttgtgatgtgtgtttattttattcaagtttgaatattgacaagtgtaacttaagctggtgactgacacctattgatctgctgtgtgcaaatgatagtactattttttagaaaactcttaagtaaattttaaaaatatttgaatacaaaatatctgagcaattttgaactcaaaagtttttcattgttttaaggattgccacaggactctttaatggtttttaatggacatacatgcctaatatttattggtgtgtttaaaatattttttgatagagtgttatgtcttaagcgcattagaaaacaattgtttgtaatggaatcaaagtgtttccctggacagtttgatgtgcttatggttgagatttataatctgcttgtactttgctttttaacttattaactgtaaataaattttagagaatacatagtgtctagtttttctaatgatttgaacatttttgaaatggtattttgtatttgtatgtgactcagaaaacatcttaatttacaatttgataaattttgacttttttgtgaacttcaaattcccagaaatctcgagatttgttttttgtgctatctcgggagtctgtgttccatcaattctttaattatctagcgaatttttaggatggcgctacaagcccaacttattaaccagtttgccagcaataaaatatcctacaaaaaaaaaatgcatcaaaattcagaattctctaaatcctgacccgaggtgcccctgtgacgatgacaaaaggtctaaagctcttgctctttcatggcatgaaaggaagtaagagtgctccatttgagtaccagtggtatgggctgttccacagaataagggcagggctagaattttcattagagtctagaaggcagaagtggagtattagtgaacagcacagcaagagccggattcatagatagtactgtgtgggctgaatttgtctttgtacctaagttcctattagttggaggaagcgtagtgtaatagttgtggagtcacagtgcctggggtggaattattatgcatacctttgtgacttgcaagtgttgagactgtaggtaagttacttaaaatctttgtgccttgcttcctcaactatcaaatgtgattagtgaaagaaactattgggatattataaggattaataactacccctttcaaagggtagtaatgctagacacataggaagtactaaataaatgctcttaattataggtatgcacagtgagaataggtatataagctgagagtggtccgttgtgagtttagctctccaggtttctcagcatcccaagaatattgtgtggctctgggaaagctgtaagataaatgaagagaagagaatttgtgcatgaataaaattgaagacataaggaaatcatataattttttagcttgctgactatgcagtaggagattggattaagttgatttattacaatttttgttgttggagtttttttaaagattcacatcttcttttgttatatctctataagacatttgaatgtactgttatgtgttttaaactatctgagaatttataacagtaatagatttaaagctgttgatccaagaacttacaaaagttttggactacatatttgcttagagtaagctcagtaagtgttgcttataaatgatgttaatttatatgcatagaaccaagctatagtttgtataaagtttataattcaggtgttaaaggaaacaaagtgagtacaatagctgtgcttgaaacaccagaaaattattactgaaagtaaaaaaaatcttgtatttgaagcattgacacactcatttttggatgtcagatataaagcctgtaatttaggtttaattcctcatagcacagagaatagaacatcctctaaattggtgaacaagccaaagttgcagttatctgaagttgacacaaaataatttcctggaaaattattagatgaaagtcatacaagaacaagaagctaaaaattgagcctaattgcagatttcacagaagtaatgacttctcactgtcatcactctcttgtgtcttggtaaatgtcattctaaaccatgatctataacataataaacatatctaaagcccaattggaaagtaataatcataaaaacaccaaacactatgtttagcccagaaaatttgaataagtagtctactgaatccaaaactggacttatttagcttccgaaagcattcatagaaaagttaaattgagattcttccaagtagtacaattaactgtaaaatgtgtacatatttctcttttcaaggatttttttcaagtacatattctttaaagagtacagaaaaaaaaagagtgtggcttagggttctaaatcttacagagtaaaaaaattattgaagcaaaaacaaatgtataaaaagtacatataaacgtacagtttgatgaattttcataaattcaataggctcatggaactagcactcagattaaaaaaatacagttatgagtacccctgaagtcctccctaacaccccatcagccattacctactcaccttcttgcccaagataaccattattttgatttcttacagcatattttttgcttatttttgaactttacataaatggaattattggtcatgtgtctagcttctttcacttgaaattatgtttgtgagattcatttatattgttgtgtgtactattattgtagatcatttattctcattggtgtatagaattccactgtgtgaatattccacaatatatttattccagtcttggtgggcatttgggtagattccagtttggaacaattataaataaagctttgatgaatattctaa

SEQ ID NO: 21 - DNA, 4723 bp, Homo sapiens
actgaagagtcatggtggggcccgggcctaccgctgctgccgctgtcgaagagcggcagagaaagcttcaggagtaccttgcagccaagggaaaactgaagagccaaaacaccaagccttatctaaaatccaagaataattgccagaatcaaccaccttctaaatctactattagacccaaaaatgatgttaccaaccatgttgttttgcctgtcaaacctaaaaggtccatcagcattaaactccagcccagaccacctaatactgcagggtcccagaagccgaagttggagccaccaaaacttctgggcaaaaggctgacttcagaatgtgtttcttctaacccatactctaagccttctagcaagagttttcaacagtgtgaagctggatcgtccacaacaggagaactgtcaagaaaacctgtggggtcacttaatatagagcaattgaaaactacaaagcagcagttaacagatcaaggaaatggtaaatgtatagactttatgaataatatccatgttgaaaacgaatctttggataactttctaaaagaaacaaacaaagagaacttgctcgatatcttaacagaacctgagaggaagccagatcctaaattatataccagaagtaagccaaagactgactcttataatcaaaccaagaacagtttagttcctaaacaagccttgggcaaaagttcagttaatagtgctgttctgaaagatagggttaataaacaatttgttggagaaacacaaagcaggactttcccagtaaaatcacagcaactctctagaggagcagatcttgcaagaccaggagtaaaaccctcaaggacggttccctctcactttattcggacccttagtaaagttcagtcatcaaagaaaccagtagtcaagaacatcaaagatataaaggttaataggagtcaatatgaaagaccaaatgaaactaagatacggtcataccctgttactgaacagagagtgaagcacaccaaacccagaacataccccagtttgcttcagggtgaatataacaacagacatccaaacatcaagcaagatcagaagtccagccaagtttgtatacctcagacatcatgtgtactgcaaaagtcaaaagccataagccagaggcctaatttgacagttggcagatttaattcagccattccaagcacccctagcataagaccaaatggaaccagtggtaataaacataacaataatggctttcagcaaaaagcacagactttggactccaagttgaaaaaggctgttccccagaaccattttctgaacaagacagctcccaaaactcaagctgatgtcacaaccgtaaatgggacccaaacaaacccaaatattaaaaagaaggcaacagcagaggatcgaaggaaacaactagaagaatggcagaaatctaagggaaaaacctataaacggcctcctatggaacttaaaacaaaaagaaaagtaataaaggaaatgaatatttcattctggaagagcattgaaaaagaagaggaagaaaagaaagcacaactcgaactgtccagtaaaattaacaacactctgacagaatgtctgaacctcatcgaagggggtgtaccttctaatgaaatacttaacatattgtccagcattcctgaagctgaaaaatttgctaaattctggatctgcaaagcaaagttgttggcaagtaaaggcacctttgatgttattgggctatatgaagaggccattaaaaatggggcaacaccaatacaagagttgcggaaagttgttcttaatatcttgcaagactcaaacagaaccacagaagggattacttctgactctttagttgctgaaactagtataacatcagtggaagagctggccaagaagatggaatctgtgaagtcttgtctttctccaaaagagagggaacaagtcacggcgacaccccgaatagccaaggcagaacagcataattatcctggtatcaaattacagattggtccaatccctagaataaatgggatgccggaagtgcaagacatgaaatttatcactcctgtacggcgttcgtcgaggattgagcgagcagtgtcccgctacccagaaatgctgcaggaacacgatttagtagtggcttctcttgatgaactgttagaagtggaagaaacaaaatgttttatattccgtagaaatgaggcgctgcctgtaacattggggtttcaaacccctgaatcataatttcttgatgctttttttaaaaaaggtgtttcagaaccaacataagacaagaaatattcttgtccaagtgacctggaaaaaaagagaggcatcatggatgcagattatggacgctcaggacttaagtaattcactgggcttactctcaaattttctctccccatgggaaaatctttgctttatgtgtttaagaccagtttgccagttttacagtatacataaatttcaaacttttgaatatttaccctacaactatgataaatatttatactttattgatctactttaatcccaacatagttttttatatcagaaggttggtcccacaatataatgggacttttctttctgcatccaccttagcagagggcaagttctttcatcgtggaagatctgaactttgacgctagcttgacaggctgaatggaccttgacagatggccaagtcaaaacccctcattttacagatgagtttatgctagctgtgcctttgctcagagatcataaatttatgtgtgatctttgactttcatcacagtatccttgtaaatgagagagaattcttgttttttctatgccaggtctcctcagatgaaacacaatcctgaattggcatggtcgtctagcttttatattcaaacctagttttgcatttgttactcagaaacacttcaagtaacaaaaggggggcaggggagaggggtggggagtggacacttgcttcttcagttctttgctcagctagggtatagctggcctgagaaggcagtgcaagccccagagactgttgtaggttgctttttcttcctcctgggcaactatttgtggaaaggttttaccttagtcattatgtaaatataattgtgtagaaaaacctagtcaacacattttaaattttagctttcttaatatttaagtattatcttaaaacaacattaaatttctattagttcctgcttgtttatcttatttattatagaaaaccatgataatggctttgcatagagaattaggagtttgtctaaggatataccagttggctgtcctaagaaacaaggagcattcattaccaaggagaatggactttgatcaaaggtctatcagcctcatccaggaactagatttttttaagggaagcagatctatttctgaaagtcagatttataataaagctcaaaaaactgagctataaacctgtaataccagcagactttcaataagagactcttacaactcaattgtggaaaaactaataattaaaaatgggcaaaggacctgagcagacatttctccaaagaagacataagaaatggccagtaggtatagatatgaaaaggtgttcagcatcattaatcataagaataatgtaaattaaaaccactgtgagctatcacctcacatctataagaatggctattaacaagacatgagataaatgttgatgagattgtggagaaaagagaaccctagtacactgtttgtgggcgtgtagactggggcagccgttatggaaaacggtatggaggctcctaaagaaattaaaaatagaactgttatctgaccctcttctgagtaagtatgtacccaaagaagatgaaatcaccagctgggcgcagtgactcacacctgtaatcccagcactttggagtgggtgaatcacctgaggtcaggagttcaagaccagcttgaccaacatggtgaaaccccgtctctactaaaaatacaaaaagtaggcgggcatggtgacgggcacctgtaatcccagctacttgggaggctgaggcagaagaatcacttgaactcgggaggtggaggttgcagtgagccaaaattgcgtcactgcactccagcctgggttacagagcaagactccatctcaaaaaaaaaaaagatgaaatcatcacctcataaagatatctgcactcacatgtttgtggcagtgttattctcaatagccaagatgtggaaacaacctaaatgcccatcaatggacaaataaagaaaatacggcatatgcatgccgtggaatagtattcatccttggaaaagagggagttcttgccatttgccacaacatagatggacctggagaacattatgctaagtgaaataagccagacccaaggaaaaatactgcatgatctcacatatggaatatttaattttttaagaaagagctcaagtacacagagaaagtgcttaccacagattggggaagaggaaatggggagatgcaggccaaggatacaaaatagcagataaaatgaacaagtctagagatagggctaaagttaatacaattgtattagggatttttgttaaataagtagattttagctgctattatcacaaaaaaactgagatgataatgttaatctgcttcactatagcagccattttattatctatatgtatcccataacatcatgttgtaaatcttaaatatacctaataaaataaaattgtcaccaaaa

SEQ ID NO: 22 - DNA, 3095 bp, Homo sapiens
ggagttgtgctctgcggctgcgaaagtccagcttcggcgactaggtgtgagtaagccagtatcccaggaggagcaagtggcacgtcttcggacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggtgaaagtatacttgagggttaggcccttgttaccttcagagttggaacgacaggaagatcagggttgtgtccgtattgagaatgtggagacccttgttctacaagcacccaaggactcttttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatggagtcactaactcagggaaaacccacacgattcaaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgtccctgctaaatggaggcctccaagaggaggagctgtccacttccttgaagaggagtgtctacatcgaaagtcggataggtaccagcaccagcttcgacagtggcattgctgggctctcttctatcagtcagtgtaccagcagtagccagctggatgaaacaagtcatcgatgggcacagccagacactgccccactacctgtcccggcaaacattcgcttctccatctggatctcattctttgagatctacaacgaactgctttatgacctattagaaccgcctagccaacagcgcaagaggcagactttgcggctatgcgaggatcaaaatggcaatccctatgtgaaagatctcaactggattcatgtgcaagatgctgaggaggcctggaagctcctaaaagtgggtcgtaagaaccagagctttgccagcacccacctcaaccagaactccagccgcagtcacagcatcttctcaatcaggatcctacaccttcagggggaaggagatatagtccccaagatcagcgagctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcagtgaacatttggacacccaaaaggaactattggaggaaatgtatgaagaaaaactaaatatcctcaaggagtcactgacaagtttttaccaagaagagattcaggagcgggatgaaaagattgaagagctagaagctctcttgcaggaagccagacaacagtcagtggcccatcagcaatcagggtctgaattggccctacggcggtcacaaaggttggcagcttctgcctccacccagcagcttcaggaggttaaagctaaattacagcagtgcaaagcagagctaaactctaccactgaagagttgcataagtatcagaaaatgttagaaccaccaccctcagccaagcccttcaccattgatgtggacaagaagttagaagagggccagaagaatataaggctgttgcggacagagcttcagaaacttggtgagtctctccaatcagcagagagagcttgttgccacagcactggggcaggaaaacttcgtcaagccttgaccacttgtgatgacatcttaatcaaacaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccaggaaaatcagcaaccaaaccaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaagatattattgttcacattttttattgaattccaaatgtagcaaaatcattaaaacaaattataaaagggacagaaaaa

SEQ ID NO: 23 - DNA, 6850 bp, Homo sapiens
aactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaattactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgtaatcaggctgaacatttctacaattactagatgtattagacgtaagtattttctttagttaaaccacccatgttagaaatgttttctgtagaatttataaacaactatcaatgcagacaatttaataagcctggggatgatttacttacagtaaacatttatcaaattgtacatttgtgctatcaacaattaataagcaaatatgtgaaaatagtttctgtcttctatgaagttagatatttgatggttaaaacccctataaatcatagtttcatatgggaaaaaataattgaaatacagtgtaaatttaaataatttattaagtatagcaaataattgaaatatggtggactaaattttgtcatagaaatatgtgcaagttatagtagtggctcacatgagaggtaatcaattctgctaatagtagcagaatgagtgcagtggaacatgaaaaacttgaggagataacagttgaggtgggtttccatagatgcataatagttcaagagcaagatttggtggggaggcactattcaagacagggactaagttcaaaatccaagacgtatgctgggacacacctctgacaggttggcataaaggaggcttaatcaaactatttttcttcttctgaaacagaagcaataattttcatttacatttgacatatcccgaggtaatattaacattagggaaagttactcttttccatctttccacattcttgcaggaccataaaatctgaattttccagtatttttaataagagggaagaaacctctctttttcttctctttttcatctcccaagagatcctcctctcatgactacagttgaataggtggtttctattggaagacattcaggaattcaaggtgcatgtccataaatggactttttttgttgttgttcagagctggaccttgaatgatgcatccttctctctgttgtaaccatgaataatgcacccttcatgctatagcctttaacgattcacccttcttattgtaaccttgaatgattcaccctttatggtgtagccttgagtgacgcacccttcatgttgtagccttcaatgatgcacactccatgttatagccttgaatgatataccctttatgctgcagcctttctcttatggggaaaagcctgcagatatcctgctgcttaactgacaagtgtggtgagaaataagtagaaatctaaagaggggaagaccattttggacacttatctgcaaggcagatccaacacacttttccagtagtcaagctacttctaattttgttcagtatcaaaatgagaaacaggcctgattctccagcactcttgtcaacacaacttccccccatatttatatatatacacacacatatatatctttatatatatacacacatatatatctttatatatatatatttatatatatatctttttgcatatatacatatatatgtatctttatttcctttgaaataaagataaatatagctgatttctttggcttcgacacttactatttgcatgactaagggaagctagttaacctttctgtgactcatttccttgtccataaaatgggaatattaattgtacatgtcttatggattggtgtgtgaattcagttagcgagtgtagaatataacttatagatcaaagtagagtaaatggaaagggctcaactatggtgttgctactgccattgttattacaggcacacagttcgagctataatcatttcaagggaaattcttatgtgtcagttctggatcgaggtctgagattctgcatttcaaacaaacttccaggaatgctgctgcttcttggtccacacttggagaaataagtcagcagagagtcctctcgtttcctattgtaccatgtctgtcttttgtctcctgcttattggcctctgtaaggaactcacagctgctataataaagtaccaaaaactgggtggcttaaaacaacagaaacttactttctcacaattctggaggctaaaaattcaaaatcaaggtgtcagcagggtcagattccttccaaagcctttaggagaggacctttccttgctcctcctaggtttctggttaaatctaggtgttctttgccttatggcagcgtgactctaatttatgcctccatcttcaccctcacatggccttctctctcatgtgtttgtgtcttttctcttcttcttctatgaacatgagttatattggattaaggctcaccctaatttagtatgaacccatcttaacttgattatatctgcaaagactctatttccaaatgaagtcagactcacaggtattgggggtttgatattgaacatatcttctgggaggagacacaacttaatcattaatatccactttcttttttccttattaaatgtttaatttttttgttttcattaaaactgttgttcgattatgggtgcttcacataaaaggttggaaacttaaaaatttgtctctgacccctcctggttggaaaggcctctgttgtacatttatgctagcctaggccataccactttctgtcttcagtacagccatcttagtttattcaagtgacacagattttccagaacacagtattcatgatcttttaaagcatttttcttcaaagactttgatctggcaataaatgttactatgtaattctcatgacataaattaggcataacttggatctcctcttcttctgctcattcatttgtctgaatcatcactattatcttttttatattcctttaccgttctccataatgcttttccaagaaactggtttattccacaattttattgcagaggcagctgcaggatatcataatcttatctttatacgaaggaagaattgcctaatccctcaagtaaactaaaaatgttttatacagtcatttctcattcatccaatgttccaggcagtcccagtccaagactgccccttcacacacacaacaactcttcacaagacttcactgtccttcagactctcctgcagcacagacattcgaggttgctgagtcgacattgcagttatttcactcttgattttgctgctcaattttaagtttccacacttattgctaaaacattccttctagtggatctgtttatgtattcaagcacaccatctgtcacaattatttcaaatcacaggtctgtgacagactgtcaatttcacaccacaaagtataatagtggaaaacaaagtaaaatcaagaaagggagaacactaaacttattaaaaccatatacaagcatacgcattcaggaaactaaaacaaccttcaaagaagttgaacaattttgagccaaaagaaagggcatatgcacaccctaccccagtataagataaccagaaaaggactgggtgagttgcctcctgagtattatgactgccatcaatcacttaggcattggagatcaggagactcttcccaggccacacattctgcagtgactgtgagggctgaatgaatgcttccaggccatcaggaacaagcatagaaacacaaatcaattttaaaatacactcaaaaatgtcaaaataatccaacttttttgtcttgatcagatatatctactagcacatattacttcattttttcagccaatatttattaataacctactgtgtgcttgacagtgttctagtggcagagacacagcagtgcataatgccttgccctctgaagcagatgttgcagcaggaggagacattccaggacatgacaattaaagtggaggaatgtcaagcagaactggggaataagggatgtgaagggggtgagacttgctattttatataggatggtcggaaaaaggacttatcaggagtgacatttgagcagggagatgaagaactgaagggagcaagccaagaaaagaggccctgaatttggaaaatacatggcacgttccaacaagagcagagaggacaaacgtgagcagagtaaagtgagcaagaagagataatatatgatacaaggtcagaaaggtaatgacaatcgcatcctgtaggactttttaggccattgtaaagatgagcttttactctgagtaagacagagagctattagaggggtctcggtagaggagtgacttgattcaactgtctttgagaggatccctttgcgtgtatagactgtaaggtaacaggaataggccaagagagaatatttcggatgctagtgcaataatcaggtgagagatgatgaagactttgacctggataatagtagaaaaattgttgagaagggatcaaaatatggggtttgttttgatggtagagaggccagggatggctgaatgatcagatggggcatgagagagaaagaaaagaaacagagatgacttcaggaattttggcctgggccactggaaggatgaagtcaccatttactgagatggtaatgactgggaggttgagctggaagaactgagaatcaaatatctggttttgaatctgttctttttgagatgcatattcaacttccatatggaggtgtcaaggaggatttagatctagaattttggagctcaagggaaagggttgagctgtagacataaattctagagatgccggaatatagattgtgatccttctttatcagcacagaaatgacttgactttgtccaaactaagcaatcatactgtacatgttagcaacacattttacagggccaatttggccttttgcaatgttctgtggtttctaagataaataaacatattatatgtttccctctgga

SEQ ID NO: 24 - DNA, 2015 bp, Homo sapiens
aggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaga

SEQ ID NO: 25 - DNA, 6543 bp, Homo sapiens
aaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctactttggtctccataacttctatgttttctttccttctgacacactagtgcccctaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatgggctccctccagcagtgcgagggtcagagtttctggagccttgggaggaggcatccctgtgagggggggttagggagatgggagggcaccaggaaaagtgattagaagtcaggtatgggaaggctaaataggacagagtcgagtacatctctgcttggaaaaacatatcaacacccttttttttgaacattatatcttgctcataaaagaaaactttccacattgttttaacaaaccccacagctgagagtcaggcctgaatctttgatgtgtgcccattcacaacgttgaccctattggtttgtggtggggcagggcatcaaagacatcattgactaatcacattcccctgaatagctcatatttagaaaatattcttagattctaaaaatgtactattaatttgtgatattcagtcttttaaatattttatacattaaacaggcatagttacaaatataaaacaaaaatatcccaaagccattatgcatggcactcaagattaaaatgggaaataatacatctaataaatcaaatgttccaagacttcaaaggtcttttggaaacaggctatgtaaaacagcacactggtttcaaactttggtaaattttaagaacaactcttacaaaggcatttaattcttatacataattttcaggggacctaagttaatcagctaatcatgaagacatgattttcattttagaaaacacttttgaaaacttgggataatctcatgccttaatgatcaaagcattatgagaaggacagtggtttttaacctgggcatatgttctaacacatttactctccactattcgtactctggtagccatgttaaccccatcagagattccttctcaagccatgtctcagagctgagaggcatcccagcaagttttgcagctcacagttttttccgtaaattacttattctataaaattggagtaggccataaactttggagggccctagaccaattttttggattatttttcgtcttctatcattccgctgatcttagatattctctgcattaaatattaaatatcacttctaggctgaaaaatccccctaaaaatatttctagctcagatttttcctccaaattctgcaatagaagatcacaatgtgaactctgcatctccatgttaaagtctaatggacattcacacttagcatgtctcaaagaaatctcatgtaaaccatggccatcctgttctaccttaactttctgagtctatggaatgataatttcacatctcataaacttgactgatgtaagtgtcaagaaaagattgacattttgttaaaagttagtagtgaagtgtgtaacgcttaagcaaactttcatatttcaaatctctttagcaagtgtaactcttttttcaagatgtgaaataatcattaggtcagtcatttgtaaatagtacatctgctatggactttttccagttcttcaccatccatttttataaaactcttattgttaaaaaaaaagttactcagaatttcataaagccaaacacctgatttcaggaacacttgagatgtaagaaaattttatagggacctccaatcactaattttcctattttttctctcaaagaaatgctgaagggaggaattcaggttgaatgaaaggaaatagtaacttacagccatatagagttataaagacttcttgtaaatgtgaacatatggtaaaatataaaaacatgtatttttgaaattttggattctactcattattttacttcaatttaagatataaatgtatagaaataagtataattctaagctaatacgtatgcaatgtaggaagctgtaattactgaccaaaactatgtgaagtggagaaaacctggggaagtggatggttttagatgaaactgaagttaaattcatattgatttaaagtaaattgttataactttataaagtttttcatcatcaccacagcaatcacaaagagaataattatgaatatacgcaagaggaaatgagaagggaatccaaatgtcattaaaaaaaaatcacgccacctcacaaaatggtaacagtggatataaaggatagaaagctataaacctggtaggaaaacattgaaaatggcacaagtgactccttccctgtcaccaatgacagtcatgtgttgcataatgcctgggctatcttctgagaatggctttgttaggcaactgtgtcatggtggggacatgatagcattagagagaattctctcaaacactgtcatggccttatcaactatgcttctgtaatattctgaatccttcgctgcctttccaacagtgtttacaacggtttcctaagaaatgaaatccatttcaccaaaccacttttcttgctcatccataagaaacacttctcctttgttaaaattacatcatgagattgcaagcattcagtaacttgcaagctccaatttgaattctagttgtcttgctatttccaccacatctgcaattactttctccactgaaatcttgcattcctccaagtcatccaggagggttgaattcacttctttcaaactcctgttcaagtaaatgttttgccctcctgtcacgaatcatgaatgtttttaatggcatctagaatagtaaatctttttcagaagattttcaattttcttttcccaggttcttcagacaagtcaccatggtagctgtagacttatgaaatgtatttcctgaaccataaaacaagaacatcaaaattactctatgatccatgggaaacagaatgcatgttgtgttagcaggcatggaaagaacagtaatctctttcaacctctgtaagagagttcttggttgattaggtaccttgtcgataggcagttctaatttcaaagaactttttcttttgctgagcagtaagtcttaacagtgggcttaaaatattcagtaaaccattatttaaggagatgtggcttaaatatctaggctttcttgctttatttatagaacacttacagagtagatatagattaaatcttaaggaccctaggattgttagaatagtaaatgaacatcatatgttgtaatatagttagccagggaggggaaagatctctacaagaaataattttaaaaactactcaaagaaatcagagatatcacaaaatgacaaaacaagtacaggggcagcaaaaggtaacagatgtcaactatgagatctcatcaagaactaagaaaatggagaaaagtaccagatggcagatgggaggcagtgtgagcatgcctctcccacttggagattagtgtgtagagatttacattgtgaatttcttttcaagaaccaatgcagagacttaacagatatatgaaaaaatttcacatacactctgaagaagtctcaggcacaatcctactccatgaaataagaaaaaaccatcacatccccagattctgaggggagagagttcactccagagcatacatccccactggggatctggaaattcaggccacaagagaaggctttgatcctgtgcggacaagtgccttgagcagaatccacaggggagagctggaagtgcatggcagatatgagcacagaagctgggtgtccagccttgtgggcagaccgggagggatgtggcctgaaagccatggttattatctcagcgtgtaagctgatgatctgaggctggtcagagttctgtgcgcagactgcctggatgtaaacctggcactgttagcagagcactgcatgaatgaaaggaatgaaaatagccttgccaactgcataggtgctgggtgaggctcactgtggggggcgcacggcaagctattcaacattacgtacaggcatttgaggtcggggcatggaaaaatactgaggcagtgtgtgtatgttatttgtgctgagaatgaaactccttgaccttgaaaacaggacagggagtggtgtgtgtgctgtgataaggaatgctgaaaacggtctcctgagaatgcggtttgagtgcttttacaaggccacaggtgtctcacgacctgacctcataaagccatctagtggatgtttgtggcttaacaagccccttcaataagtacttggcggagggatgctggggggaccttcttagaagagctgcgccccacccccctccctggacagcccagctacaattgtctgagaactcactgcaagctgtaagcggcccactacttcccactcccttttttgaactcttctgtgcagcagaggcaattaaactctcctctggaacattaccccagcagcctgagaaccaccccttggcgctcacaggggctgcagcctgccttatccaaggacagttagagtgcagacccacctaaccctggacccactggtggtacccatccacccatcctggtagcttaacacaaagatacacttttaggagcttcatagcccctcttcccccattgcctgagaaaccactttccctgggcaacttagggcaagctcaaatcccactgctaccaccacagctggtgctcttttgcaagtgccacctcctagctggagaccaaccagcacagtccacacagcacctcaaggaagaataaatagaactgttcccaggaaggagaaaatgcctgcatgagctcagctgttaccactgcgtaccacaccctgaccagtcagaggtcttgagtcggtccgcatgacaagttcaccgctcgcataaccagcattcaagaaagccagcacactaagcctatctacagccagggagtctcagagtctacgtcactcccctgccacctcaatcagagctggtgctggtatccactgctgggagacttgtgctgaggtgaagcctgggctggatggctggaggatgaagaactgcacggaggagatggaggcacccagacagatgccccatggacatcctgaagcagagctgcctcactgccctgcacacacatgagagcgcagccaggaacagaaggactgggcaacattcaggcggagcccaggccaattttctaaacatggaatatgagttaaataaatggcttcgtattaaa

SEQ ID NO: 26 - DNA, 3786 bp, Homo sapiens
aggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 27 - DNA, 1462 bp, Homo sapiens
gctggaggtgaaagtctggcctggcagccttccccaggtgagcagcaacaaggccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacacaaactccgtacgtcttctcttatggaagtggctgtgtctttttgagggactctgttctttgcctcagttgtctaccaaaggtgccacatttatagtggctttgtagtaaaggactaaagtctta

SEQ ID NO: 28 - DNA, 2748 bp, Homo sapiens
ggcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttgagtcaccacatactatggacatgtcaattatattagaagatgaaaagccagtgagtgttaatgaagtaccagactaccatgaggatattcacacataccttagggaaatggaggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatgtttttgggagaattaagtttgatagatgctgacccatacctcaagtatttgccatcagttattgctggagctgcctttcatttagcactctacacagtcacgggacaaagctggcctgaatcattaatacgaaagactggatataccctggaaagtcttaagccttgtctcatggaccttcaccagacctacctcaaagcaccacagcatgcacaacagtcaataagagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtcaggataataaattgatttggaaaactttgcaagtcaaatttaacttcttcaggattttgcttagtaaagaagtttacttggtttactatataatgggaagtgaaaagccttcctctaaaattaaagtaggtttaggaaaacagaccctcaaattctgacattcattttcctaagcaactggatcaatttgctgacttgggcataatctaatctaagcatatctgaatacagtattcagagatagatacagtagagattccccagactttttcgctctttgtaaaacctgtttgtttaggttttgcgaggtaaactcaacagaggttgggagtggaagagggtgggaagcttatatgcaaattaacagacgagaaatgctccagaaggtttattattttaaagcacattaaaaacaaaaaactatttttaaaatcctgctagattttataatggatttgtgaataaaaaatacccagggttctcagaatggaataaatatcccttttaatagttatatatacagatatacaactgttagctttaattggcagctctcttcttttttcttcttttcactggctttttacttggtgctttttcttgttttgcactggtggtctgtgttctgtgaataaagcaaagtaagaatttactaagagtatgttaagttttggattattgaaataagaggcatttcttagttttccagtaggatctaaaatgtgtcagctatgagtaagactggcatccaagaagtttatattatagatttaggtcctaatttttataaatcacaaggtaaaaaaatcacagaacagatggatctctaatgaaaaagggatgtctttttgtttatagtcatgtggcaagatgagagtaaaaccagagagcaaacctctataagtgttgagtatatgtatacatttgaaataaaccagaaatttgttacctta

SEQ ID NO: 29 - DNA, 5736 bp, Homo sapiens
aggcggcggcggcagcggcggcggttggtcaggggcgtgttggccccgcacagattgagccgagttgtcgccccgctgggagaagtgaccctcctgcgcctgatcagaacactgaggctcagagaagttaactactccaaagtcatatagccagtattttctggagctgtaattcaaatcagatgtgttcaataccttctactaccccattgctgtctttatgaaaagaaatttcatttcaatataggtgactatgcagcctgcaattcaagtatggtttggagaagatctgcctctaagtcctcggagtcctctgactcccagacacggaccaggattggctaatgtttgtcagtacgatgagtggatagctgtgaggcatgaagccactttgttgcccatgcaagaagatctgtcaatctggttatctggtttattaggtattaaagttaaggcagaaaaattattggaagaacttgataatggagtactattatgtcaactgattgatgttcttcaaaacatggtgaaaacatgcaactctgaagaatcagggaattttccaatgagaaaagtgccctgtaagaaagatgctgcatcaggttcattctttgctcgggacaataccgcaaacttccttcactggtgtagggacattggggttgatgaaacttacctctttgaatctgaaggtttagttttgcacaaagatccaagacaggtgtatctttgtcttcttgaaattggtcgaattgtgtcaagatacggggttgagccaccagtgttagtaaaacttgagaaagaaattgagttagaagagactttgcttaatacttctgggcctgaagattccatcagcattccaaaatcatgctgtcggcatgaagagctacatgaagctgttaaacatattgctgaggaccctccttgtagttgttctcatcgattttctattgagtatttatctgaaggacggtaccgactaggggataaaatactctttataagaatgcttcatggaaaacatgtcatggttcgcgttggtggaggctgggatactcttcaaggatttttgcttaaatatgacccctgtcgaatattacagtttgccacattagaacaaaaaattttagcatttcaaaaaggagtttctaatgaaagtgtacctgattcgcctgccagaacacctcagcctcctgaaatgaatcctttgtcagcagttaacatgtttcagaaacaaaattcaaaacccagcgtgccagttagtattccaaaaagcaaagaaaaacagggacgtccaccaggtgcattggtgccagcatcttcactgaaaggaggtaatctgggctctatgtcagtccgttctaaattgccaaattctccagcagcatcttctcatcccaagctcaagtcttcaaaaggcataacgaagaaaccgcaggctccttcaaacaatgcatcatcttcacttgcttcattaaatccagtaggtaaaaacacttcttcaccagctttaccaagaactgcaccttgtatatctgagtcaccgagaaaatgtatttcatcccccaatacccccaaggccaaggttattccagcccagaattcagcagatctgcccgagtccacacttttgccaaataagtgttcaggaaaaactcaacctaagtatttgaaacataatcatatttcttccagagataatgcagtatctcacttagctgcacattcaaattcatcctcaaaatgtcccaagctgcctaaagcaaatatacctgtaagacctaaaccttctttccagtcctctgcaaaaatgacaaaaaccagttccaaaaccatagccacgggtctaggaacacagtctcaaccatccgatggagccccacaagcaaagccagtcccagcacagaaacttaaatcggccttgaatttaaatcagccagtttctgtgtcctcagtttctcctgtaaaagccacacagaaatcaaaagataagaatatagtttcagctaccaaaaagcagcctcagaataaaagtgcatttcagaagacaggacccagctccttgaagtctcctggccgtaccccactgtccatcgtgagcctaccccagtcttctaccaaaacacaaactgcaccgaagtcagcacagactgtcgctaagagccagcattcaactaaagggcctcccagaagtggcaaaaccccagcttcaatcaggaaaccaccctcatctgttaaggatgcagatagtggagataaaaaacctactgcaaagaaaaaggaagatgatgaccattattttgtcatgactggaagtaagaaacctagaaaataaatacatactcattataaaaaaagagaaaaggaagaatgaatgtgttagcttcacatcttaaaagtttctcctatttgtgtctgtctaaataggtgcagacactaaggatagtgaggatggaggctgggatgaggaaagggttcatcagaattcacatatctgaattcactggaaagagcccttctgaagcaaacagttgtaaaatcactgcaaggtttttattaataatagacatgtatatgattttcagtctatagcatctttgttaacatctgccttttgcaggaaatgtaaaagttatttaacactacaagaattttaacaatagttgctctatttttgaatatgtattaaatatggagttcatatacctgctaatatcaacggtggtgctcttactattagttaattgcattttggttaaaaaaaaaaaagcaacagtttggcacttgtcctacaaaaggcacctaatttaattttctgatcaggattgcctgatccaacagtgctaagtcatggctgctgctgactagcttggcattattctgtgttaggtagaattcttattatttatttttttaagctttccaaattggaaggaactgattgtttcatgtggcttatatttacattggtaatattttgtcaccaatatttttggttaaaaaaaatccaacaaattaacttactgaaatataaacaaattttgtaaacaattttttatattatctataaaaacgtagacaccttatgtttcacatgttgtgcaatgtgacaggggaagctgatttagtagcttttagcatattaaaaataattttttataatgtaatttcctgtgagtgcagacctgacattttacattaaaataatgtgaaacatcagaattatgttttaacaactttaaaattaagatgatgttaaaataattttagagttatgctatgtaaaaattctatcatgaaattatttttctctagatagcacaataccaattttaattaatttcttccaattaggttacttttctttaataaagttatgctgccttcagttttccaatggcaagtagacaggatatgttcaaggttttctgcactgtaggcacagtctctcaagcatatcctgatcatgtaatgactgcataaactccatcaacctaaggtgatacttgtaaataatttatttttaagggatggtgactttaaaaattattaatgaactttgagaagttttaagagtgcttttaaaacttcacagtattgccaattatcttaggttattcagtattcaggtttgtgtttctctgttttaaactaaaatgtgttttctgaagaaaaaaataatagtttacacaaatgtacaatcatagaataagcattttaagctggcgactagtgttctatagattacaaagcaagaaaactttctatgaagataaatgaccttttgcctgaagagtacagataaaatcaaagatgtgtgcaagctagtttttggaagaagtgatgcttctcttctttaaagagacagtcaccaaatacttggtttaactcgactattgacttgggcattgagagagatgatatatacatctttggaaagtgaagtcaatgttcaagaggtgatagaagctttactttttagtgatcagaaatatttagtgcatcttttcagacaggaagaattttatcatcaagtattcccttataaaaccaagtaacacttctttatcagtaacttttagaacttaaaagaaagcaaaaagtaaatggaattgtaggcaatttatgaatcctagtagattttacaatatgtaatttatgttgtttacagtatataaacactaagttttgtgttaaatgtgatcaggaataaaagtatcccacaggcatctgacacaaattccagaattagccaaagaattgtttatttgaggccaggcaatcccagcattttgggaagccaagttgggcagatcacgaagtcaggagttcgaaatcagcctgaccaacatggtgaaacctcttctctactaaaaatacaaaattagccgggcatggtggcacatgcctataatctcagctactcaggaggctgaggcaggaggatcgcttgaacccgggaggcagaggttgcagtgagccaagattgcgccactgcactccagcctgggcaacagagtgagactctgtctcaaaaaaaaaaaaaaagaaaaagaaaagaaaaaggtttatttgaataattggaagtcagtttatacattactatttttcagcagtagggaatttctccaattacattcatgttgaatgaatttttatttatatatagcttacccttccaaaataaaagtgtttttttaatgttgttttgttttgttttgtttttttccttttttgagacggagtttcactcttgttgcccagactggagtgcagtggcacaatctcagctcattgcaacctctgcctcctgggttcaagtgattctgctgcctcagcctcctgagtggttgggattacaggcatccaccaccaggcccagctaatttttttgtattttcagtagagatgggggtttcaccatgtcggccaggctgatctcaaactcctgacctcaggtgatccacctgcctcagcctcccaaagcgctgggattacaggcatgagccatcacacccagcgaaaagttttgtttgaataaacaatatccgaaagacaattagtttcttcagatgtattttgaaattctcctaaagagctagtgtttctattcattttcacaatttaaaaacagctcttaacattgctgaagttgggagaactttccatctcttcttaataacagtgcaagattttgtaaattcttttttgtgtttaatgtttaataaaacgagtattaagcttaaattactgaagtacctgggagaagtaatgatgtgtactttcaaaaaaatggaaaatgcttttattttattttctataatttgttaacatgatatgtaaaattaaacttcggagcacaatgaaatgccgattatttttaccttgtttgggcttaaagtaggtatttaaggtttatgtgttcaaaatgccttggtaaattggatgacctctaactttactgtccatatggagtttgtcattctttatggataagagaacttaaggaaaagttactgtttttcttcagtctttttatatctatctgatttaaaatctgttactttattaaaaggcttcaacaacaggttgttaggatgtagtcttacatccaggttcacataataaccccatttgaatccaaatttgtgtatattttcttatgccagcagtatttgtatccaattttaacttaggtttgttttcttgagtattaaaatttaaacatatata

SEQ ID NO: 30 - DNA, 2605 bp, Homo sapiens
cttaaacgcgactcaaggcgtcgggtttgttgtcaaccaatcacaaggcagcctcgctcgagcgcaggccaatcggctttctagctagagggtttaactcctatttaaaaagaagaacctttgaattctaacggctgagctcttggaagacttgggtccttgggtcgcaggtgggagccgacgggtgggtagaccgtgggggatatctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagagggtctcactccattgcccaggccagagtgcggggatatttgataagaaacttcagtgaaggccgggcgcggtggctcatgcccgtaatcccagcattttcggaggccgaggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtctaaaaaaaaaaaaaaaa

SEQ ID NO: 31 - DNA, 4045 bp, Homo sapiens
tcccggtgtgggtactgctgtctgtggtgtggctgtgggacccgtgagcaagcagcgacgccagcggcggagaaccgacgaaaggtgtcaccacagtgatggcagtggaggacagcacgctgcaagtagtggtacgggtgcggccccccacccctcgggagctggacagtcagcggcggccagtggttcaggtggtggacgagcgggtgctggtgtttaaccctgaggagcccgatggagggttccctggcctgaaatggggtggcacccatgatggccccaagaagaagggcaaagacctgacgtttgtctttgaccgggtctttggcgaggcggccacccaacaggacgtgttccagcacaccacgcacagcgtcctggacagcttcctccagggctacaactgctcagtgtttgcctacggggccaccggggctgggaagacacacaccatgctgggaagggagggggaccccggcatcatgtacctgaccaccgtggaactgtacaggcgcctggaggcccgccagcaggagaagcacttcgaggtgctcatcagctaccaggaggtgtataatgaacagatccatgacctcctggagcccaaggggccccttgccatccgcgaggaccccgacaagggggtggtggtgcaaggactttctttccaccagccagcctcagccgagcagctgctggagatactgaccagggggaaccgtaaccgcacgcagcaccccactgatgccaacgcgacttcctcccgctcccatgccatcttccagatctttgtgaagcagcaggaccgggttccaggactgacccaggctgtccaggtggccaagatgagcctgattgacctggctggctcagagcgggcatccagcacccatgcgaagggggagcggctgcgggagggggccaacatcaaccgctctctgctggcgctcatcaacgtcctcaatgccttggccgatgcaaagggccgcaagacccatgtgccctaccgggacagcaaactgacccgcctgctcaaagactccctcgggggcaactgccgcacagtgatgatcgctgccatcagcccctccagcctgacctacgaggacacgtacaacaccctcaaatatgccgaccgggccaaggagatcaggctctcgctgaagagcaatgtgaccagcctggactgtcacatcagccagtatgctaccatctgccaacagctccaggctgaggtagccgctctgaggaagaagctccaagtgtatgaggggggaggccagcccccaccacaggacctcccaggatctcccaagtcgggaccaccaccagaacaccagccctgcaccccagagctccctgcagggcctagagcccttcaagaggagagtctggggatggaggcccaggtggagagggccatggaagggaactcttcagaccaggagcagtccccagaggatgaggatgaaggcccagctgaggaggttccaacccagatgccagagcagaaccccacacatgcactgccagagtcccctcgcctgaccctgcagcccaagccagtcgtgggccacttctcagcacgggaactggatggggaccgttctaagcagttggccctaaaggtgctgtgcgttgcccagcggcagtactccctgctccaagcagccaacctcctgacgcccgacatgatcacagagtttgagaccctacagcagctggtgcaagaggaaaaaattgagcctggggcagaggccttgaggacttcaggcctggccaggggggcacctctggctcaggagctgtgttcagagtcaatccctgtgccgtctcctctctgcccagagcctccaggatacactggccctgtgacccggactatggcgaggcgactgagtggccccctgcacaccctgggaatcccgcctggacccaactgcaccccagcccaggggtcccgatggcccatggagaagaagaggaggagaccaagcgccttggaggcagacagtcccatggccccaaagcggggcaccaagcgccagcgccagtccttcctgccctgcctaaggagagggtctctgcctgacacccaaccttcacaggggcccagcacccccaaaggagaaagggcctcctccccctgccattcccctcgcgtttgcccagccacagtcatcaaaagccgggtgcccctgggcccttccgccatgcagaactgctccaccccgctggctctgcccactcgagacctcaatgccacctttgatctctctgaggagcctccctcaaagcccagtttccatgaatgcattggctgggacaaaataccccaggagctgagcaggctggaccagcccttcatccccagggcacctgtgcccctgttcaccatgaagggccccaagccaacatcttccctccctgggacctctgcctgcaagaagaagcgcgttgcgagttcctcagtctcccatggccgcagccgcatcgcccgcctccccagcagcactttgaagaggccagctgggccccttgtactcccagagctgcccttgagtcccctgtgccctagcaaccggaggaatggaaaggacctcatcagggtggggagagcactctcagcagggaacggcgtcaccaaggtgtcctgaccgccagaatgtcctgaccaccaaggtgtcctaacctaccggcccctctgctggatacccctcttggacctgtagccacctgcaccaggagctggacctgccttccttacctgggagcaattagtgccaacacacctttgctgtattaacatccctccccagacatccatcctgctactcaccctctgttaatctcctgttacactcagcttcttggcatgtacatattcatttgtgagtgttaatgtgctgctgttttttgttttttggtggtttttgttttttgttttttttgttttgagatggagtcttactctgtcgcccaggctggagtgcagtggtacgatcttggctcactgcaacctccgcctcctgggttcaagtaattctcctgcctcagctttccaagtagctgggattacaggcacccatcaccacacccagctaattttcgtctttttaatagagagggggtttttccatgttggccaggctggtcttgaactcctgacctcaggtgatccgcctgcctcagcttcccaaagtgctgagattacaggcatgagctaccacgcctggcccgtgttgctgttttaaaggtgctgccatgttcccccatcttttttttttttgagatggagtctcgctctgtcgcccaggctggagtgcagtggtggcgatcttggctcactgcaagctccgcctcccaggttcacaccattctcctgcctcagcctcccaagtagctgggactacaggcgcccaccaccacgcctggctaattttttgtatttttagtagagatggggtttcaccgtgttagccaggctggtctcgatctgacctcatgatccacccgcctcggcctcccaaagtgctgggattacaggcgtgagccactgcgcccggcctcccctctcatttatgatgccctctgtgcaggcagacggctcttgggctcttttccccacctgtctctaacacaggccccacggtgatggccacaggcagtagaggaggaatgaggatgggttggggagcggggagtcgcggcttggctcttcctggtttctgagagggacatcttcatccctactccccttggtccccaaccacagtcctggtgaagatgtggatgataatggtgccttgatttccaaatgaagacagctttattgcttaactctattgtacataggatacacgttcagtgtaaaataaagtgtaaaggggaattcaggcttaatgctgcacctagatataaatgctaatgatacttgggtttatagccttctgatcctttatttctgcatatatatatagatatatacatatatttttggtataacaataaaccgtctccatccttaaaaaaaaaaaaaaaaaaa

SEQ ID NO: 32 - DNA, 4264 bp, Homo sapiens
gcctctgggtcagttacgcagctgtcttccaggtgactggatgtgttgatcagcgctcgctgggatttggctgacgtggccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggcttcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcagtgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattccaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgcaaa

SEQ ID NO: 33 - DNA, 5057 bp, Homo sapiens
acatctgttgatctgacctgactggaagcgtccaaagagggacggctgtcagccctgcttgactgagaacccaccagctcatcccagacacctcatagcaacctatttatacaaagggggaaagaaacacctgagcagaatggaatcattatttttttcccaaggagaaaaccggggtaaagggagggaagcaattcaatttgaagtccctgtgaatgggctttcagaaggcaattaaagaaatccactcagagaggacttggggtgaaacttgggtcctgtggttttctgattgtaagtggaagcaggtcttgcacacgctgttggcaaatgtcaggaccaggttaagtgactggcagaaaaacttccaggtggaacaagcaacccaggttctgctgcaagcttgaaggagcctggagcgggagaaagctaacttgaacatgacctgttgcatttggcaagttctagcaacatgctcctaaggaagcgatacaggcacagaccatgcagactccagttcctcctgctgctcctgatgctgggatgcgtcctgatgatggtggcgatgttgcaccctccccaccacaccctgcaccagactgtcacagcccaagccagcaagcacagccctgaagccaggtaccgcctggactttggggaatcccaggattgggtactggaagctgaggatgagggtgaagagtacagccctctggagggcctgccaccctttatctcactgcgggaggatcagctgctggtggccgtggccttaccccaggccagaaggaaccagagccagggcaggagaggtgggagctaccgcctcatcaagcagccaaggaggcaggataaggaagccccaaagagggactggggggctgatgaggacggggaggtgtctgaagaagaggagttgaccccgttcagcctggacccacgtggcctccaggaggcactcagtgcccgcatccccctccagagggctctgcccgaggtgcggcacccactgtgtctgcagcagcaccctcaggacagcctgcccacagccagcgtcatcctctgtttccatgatgaggcctggtccactctcctgcggactgtacacagcatcctcgacacagtgcccagggccttcctgaaggagatcatcctcgtggacgacctcagccagcaaggacaactcaagtctgctctcagcgaatatgtggccaggctggagggggtgaagttactcaggagcaacaagaggctgggtgccatcagggcccggatgctgggggccaccagagccaccggggatgtgctcgtcttcatggatgcccactgcgagtgccacccaggctggctggagcccctcctcagcagaatagctggtgacaggagccgagtggtatctccggtgatagatgtgattgactggaagactttccagtattacccctcaaaggacctgcagcgtggggtgttggactggaagctggatttccactgggaacctttgccagagcatgtgaggaaggccctccagtcccccataagccccatcaggagccctgtggtgcccggagaggtggtggccatggacagacattacttccaaaacactggagcgtatgactctcttatgtcgctgcgaggtggtgaaaacctcgaactgtctttcaaggcctggctctgtggtggctctgttgaaatccttccctgctctcgggtaggacacatctaccaaaatcaggattcccattcccccctcgaccaggaggccaccctgaggaacagggttcgcattgctgagacctggctggggtcattcaaagaaaccttctacaagcatagcccagaggccttctccttgagcaaggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggagaatgggatgattgtccacattctttctgggaaatgcatggaagctgtggtgcaagaaaacaataaagatttgtacctgcgtccgtgtgatggaaaagcccgccagcagtggcgttttgaccagatcaatgctgtggatgaacgatgaatgtcaatgtcagaaggaaaagagaattttggccatcaaaatccagctccaagtgaacttaaagagcttatatatttcatgaagctgatccttttgtgtgtgtgctcctggtgttaggagagaaaaaagctctatgaaagaatataggaagtttctccttttcacaccttatttcattgactgctggctgctttaaaaaaaaaaaaaaaggatccattgtaccgttgtcttcatcactgggaaatgattattacatagtacagaagattctttgtttttctccactgagcacttaacaattgctttctctctggcctggacattctctggcagcacctccaggatacataaattcaatggatcaatttatttgtcttcaaatggccttaacttggattgtctgtttggccaaccatgaaaattaaagagtgaagcagatgtaatggcctgacattccaaaaactctgaattgggtttattagcacaaatgttgtgttcatttgttgagccatatctcagaagaaggaaagggagctacagaaaggaggtttaggattgcagagaagatgcaagagcactttggcccaattctccagctcaacccagcagctgaaaagcttcaagagatctaggaaaagacattttcatgttaatgagaatttccaccattgtagagaatttccttcctactgagaatctacctctattccccctgccctagctcttctctaacttggttaaccataaccataaccagattcccttgcaatcgatttctctttagtcgttggtgttagaagtaccagcacaatttgagcattcccattaacaaaggtgttcacagttgagaaactctcctgccgggcgcggtggctcatgcctgtaattccagcactttgggaggcagagttgggaggatcacctgatgtcaggggtttgagaccagcctggtcaacattgcaaaaccttgtctctactaaaaatacaaaaattagctgggcatggtggcgcatacctgtaatcccagctacttgggaggctgaggcaagagaatcgcttgaacccaggaggcagaggttgcagtgagctgagatcatgccattgcactccaacctgggtgacagagtgagactccatctcaaaaaaaaaaaaaaagagagaaactctcctgatgccctgttacagggtttgcactgactggagcagaaacagcaacctttctaaaaaagcaaacctttttcctgggaggaaaatgccagagcctgagccaaaattcttatgacaggtaacatttgggtgttaatgtccatgagagctgacagggccatctctgagcccatataactgtctggaacccccaaatgtgtccacaggttgaatgtccatgagtgtgggaagaacacggctcatctggagcacagctgaggctagtaagagctaaatgactttccttgctatgacttggcttacctgaattagctgtaagagttgccgaatgggatgggttctgctatttaataaacagcattcatattcatttttccccagatggagttacctacctttccacatggtcagcttagaaatcttcccctaaagatgctaatctcctttgggctgtctcagaacacagtatccttcaaataagaaaaactgagtgggaagtgcagtgtttccaaacaatacctatcataactacgtattcattgtctacctgctaagtcaagggttcactgcatttctccttcctcagaatacactctggacctgtgctgtctaatatggtagccactaacaaaatgtggccattttgatggaaatccattaaaatcaaagaaaatttaaaactcaattcctcaattgggctggccacatttcaaatgctcactacccacctgtggctagggtctacttctactgtattggcgagcatggatatagaacatttcatcacagttctgttggaccaatctagatagattcattatcccatctagagaagagactttagtcactgtcttcttgcttcagacccatctatatttaaaacaaatttccctaaatcctgagactgagacggagctacaaattctcagatggcgaccgtgtaaatggtattagcggctgaagaaaaaaaatttttcaagacctctgttttttaactgaactttatcattggcattgtgggtctttgaagttgctgggataaattaatataattaaataaaagactgaatttaattgcataaattgtattaggtggcaattaacaaaaggacccagatggcttattgcctaattgggtgaacaaagcaagaatatggtgtttcttgcttccttaaccagctccatgatttattactttattgcagaagtggctgtcaactcagtccctggctggtatttacagacccttaatttaagtaaaacagatgcctccatttagttctagaaggaccttctcctttagtgtaaccaagtgttcaaattcccttcttctctatgaactcagcattcattttatccataatgatcaatttaaaagtagagaaacttgtcagttgagagatctgattcccaagagattggtttcacttgtctacctgaattttgtgattggattttgttgttcgttttttaagattgaattttgttaccaccccca

SEQ ID NO: 34 - DNA, 5695 bp, Homo sapiens
aaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaa

SEQ ID NO: 35 - DNA, 5643 bp, Homo sapiens
gagagcgccgagacgcgcggggcgcggagatgtgcaagtggcgaagcttgaccgagagcaggctggagcagccgcccaactcctggcgcgggatctgctgaggggtcacgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgcagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctgtagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttacgtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctg

SEQ ID NO: 36 - DNA, 820 bp, Homo sapiens
actcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcagg

SEQ ID NO: 37 - DNA, 2054 bp, Homo sapiens
atacaggtctgtgaagcaggcaggttgctcagctgcccccggagcggttcctccacctgaggcagactccacgtcggctggcatgagccggcgcccctgcagctgcgccctacggccaccccgctgctcctgcagcgccagccccagcgcagtgacagccgccgggcgccctcgaccctcggatagttgtaaagaagaaagttctaccctttctgtcaaaatgaagtgtgattttaattgtaaccatgttcattccggacttaaactggtaaaacctgatgacattggaagactagtttcctacacccctgcatatttggaaggttcctgtaaagactgcattaaagactatgaaaggctgtcatgtattgggtcaccgattgtgagccctaggattgtacaacttgaaactgaaagcaagcgcttgcataacaaggaaaatcaacatgtgcaacagacacttaatagtacaaatgaaatagaagcactagagaccagtagactttatgaagacagtggctattcctcattttctctacaaagtggcctcagtgaacatgaagaaggtagcctcctggaggagaatttcggtgacagtctacaatcctgcctgctacaaatacaaagcccagaccaatatcccaacaaaaacttgctgccagttcttcattttgaaaaagtggtttgttcaacattaaaaaagaatgcaaaacgaaatcctaaagtagatcgggagatgctgaaggaaattatagccagaggaaattttagactgcagaatataattggcagaaaaatgggcctagaatgtgtagatattctcagcgaactctttcgaaggggactcagacatgtcttagcaactattttagcacaactcagtgacatggacttaatcaatgtgtctaaagtgagcacaacttggaagaagatcctagaagatgataagggggcattccagttgtacagtaaagcaatacaaagagttaccgaaaacaacaataaattttcacctcatgcttcaaccagagaatatgttatgttcagaaccccactggcttctgttcagaaatcagcagcccagacttctctcaaaaaagatgctcaaaccaagttatccaatcaaggtgatcagaaaggttctacttatagtcgacacaatgaattctctgaggttgccaagacattgaaaaagaacgaaagcctcaaagcctgtattcgctgtaattcacctgcaaaatatgattgctatttacaacgggcaacctgcaaacgagaaggctgtggatttgattattgtacgaagtgtctctgtaattatcatactactaaagactgttcagatggcaagctcctcaaagccagttgtaaaataggtcccctgcctggtacaaagaaaagcaaaaagaatttacgaagattgtgatctcttattaaatcaattgttactgatcatgaatgttagttagaaaatgttaggttttaacttaaaaaaaattgtattgtgattttcaattttatgttgaaatcggtgtagtatcctgaggtttttttccccccagaagataaagaggatagacaacctcttaaaatatttttacaatttaatgagaaaaagtttaaaattctcaatacaaatcaaacaatttaaatattttaagaaaaaaggaaaagtagatagtgatactgagggtaaaaaaaaattgattcaattttatggtaaaggaaacccatgcaattttacctagacagtcttaaatatgtctggttttccatctgttagcatttcagacattttatgttcctcttactcaattgataccaacagaaatatcaacttctggagtctattaaatgtgttgtcacctttctaaagctttttttcattgtgtgtatttcccaagaaagtatcctttgtaaaaacttgcttgttttccttatttctgaaatctgttttaatatttttgtatacatgtaaatatttctgtattttttatatgtcaaagaatatgtctcttgtatgtacatataaaaataaattttgctcaataaaa

SEQ ID NO: 38 - DNA, 471 bp, Homo sapiens
acattttctcggccctgccagcccccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatagtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatga

SEQ ID NO: 39 - DNA, 1642 bp, Homo sapiens
acaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 40 - DNA, 5467 bp, Homo sapiens
aacccactgctttattctgccctgagtggagattggttttggctcaggctgctttgtgaaactcagaagcattatcctctctgccaactccacgtcctagtcagagttttctgtgaaggcaagggcatggggttgccggagagaagaggattggtcctgcttttaagcctagctgaaattcttttcaagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacagtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacttctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataacgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgttcaatgaatgaatgaatgtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgtaaattgctatttaagtgtaaagcagttctaagttttagtatttgggggattggtttttattatttttttcctttttgaaaaatactgagggatcttttgataaagttagtaatgcatgttagattttagttttgcaagcatgttgtttttcaaatatatcaagtatagaaaaaggtaaaacagttaagaaggaaggcaattatattattcttctgtagttaagcaaacacttgttgagtgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgaattatcctcagtgtagcttcttggaattcagtttctggaactagagatagagcatttattaaaaaaaactcctgttgagactgtgtcttatgaacctctgaaacgtacaagccttcacaagtttaactaaattgggattaatctttctgtagttatctgcataattcttgtttttctttccatctggctcctgggttgacaatttgtggaaacaactctattgctactatttaaaaaaaatcagaaatctttccctttaagctatgttaaattcaaactattcctgctattcctgttttgtcaaagaattatatttttcaaaatatgtttatttgtttgatgggtcccaggaaacactaataaaaaccacagagaccagcctggaaaaaaaaaaaaaaaaaa

SEQ ID NO: 41 - DNA, 551 bp, Homo sapiens
gccaaacaccttcctgacaccatgagggccagcagcttcttgatcgtggtggtgttcctcatcgctgggacgctggttctagaggcagctgtcacgggagttcctgttaaaggtcaagacactgtcaaaggccgtgttccattcaatggacaagatcccgttaaaggacaagtttcagttaaaggtcaagataaagtcaaagcgcaagagccagtcaaaggtccagtctccactaagcctggctcctgccccattatcttgatccggtgcgccatgttgaatccccctaaccgctgcttgaaagatactgactgcccaggaatcaagaagtgctgtgaaggctcttgcgggatggcctgtttcgttccccagtgagagggagccggtccttgctgcacctgtgccgtccccagagctacaggccccatctggtcctaagtccctgctgcccttccccttcccacactgtccattcttcctcccattcaggatgcccacggctggagctgcctctctcatccactttccaataaagagttccttctgctcca

SEQ ID NO: 42 - DNA, 1371 bp, Homo sapiens
aatcattagagcctgagtcactctccccaggagacccagacctagaactacccagagcaagaccacagctggtgaacagtccagcctgtctccagttggactagccacaattcaagtgcttgaaaaccacatgtggagcagacaagatggagacaaattcctctctccccacgaacatctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcgtctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaatgtggccgttgccatgttgacggtgagaggcatcatccggttcatcattggcttcagcgcacccatgtccatcgttgctgtcagttatgggcttattgccaccaagatccacaagcaaggcttgattaagtccagtcgtcccttacgggtcctctcctttgtcgcagcagccttttttctctgctggtccccatatcaggtggtggcccttatagccacagtcagaatccgtgagttattgcaaggcatgtacaaagaaattggtattgcagtggatgtgacaagtgccctggccttcttcaacagctgcctcaaccccatgctctatgtcttcatgggccaggacttccgggagaggctgatccacgcccttcccgccagtctggagagggccctgaccgaggactcaacccaaaccagtgacacagctaccaattctactttaccttctgcagaggtggagttacaggcaaagtgaggagggagctgggggacactttcgagctcccagctccagcttcgtctcaccttgagttaggctgagccacaggcatttcctgcttattttaggattacccactcatcagaaaaaaaaaaaaaagcctttgtgtcccctgatttggggagaataaacagatatgagtttatta

SEQ ID NO: 43 - DNA, 3735 bp, Homo sapiens
attgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactcaacatgtaacattcaaaattgtgatcttcataaagacattgttaccattcgtcttgcaaatttaagacaactgaatgaaaagccaattttttgaaagaatgtggcatataattagatatacaactgaaacaggatatacaactgcatacaatttgtttttaatgatattttaaaatagcctgttagcaggaaaatagtccctatttatctgctaatggtcaaaaagagttaggatataaatcgtaccaaaatgtttccaatcactcagaaaaactgattcatgtctggctttgcaacaccttaaacatttattctgtcatagatagtaaagccccatctcagtttatttagtcctgaggttggcagcatggggtttgactatatgagctaaaagatacacaaagagataacgctgtttcataataaacaggaattgactatacaaataggtaaaccagcatatctacctgtatttctcagagtttagatgtgtgctttatgtttacattaaaataaagcctaacgccacagtagatcatctcatactgca

SEQ ID NO: 44 - DNA, 6641 bp, Homo sapiens
ggttacattttggatcctcgcggagtactggtcaggcggttaagtcctgtacctaggaaagagggcgagctctggggcgctctccggtgtcatgaggagcttcaaaagagtcaactttgggactctgctaagcagccagaaggaggctgaagagttgctgcccgccttgaaggagttcctgtccaaccctccagctggttttcccagcagccgatctgatgctgagaggagacaagcttgtgatgccatcctgagggcttgcaaccagcagctgactgctaagctagcttgccctaggcatctggggagcctgctggagctggcagagctggcctgtgatggctacttagtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgcagctcggctgaaggccttgagcttcctagtactcttggaggatgaaagtaccccttgtgaggttcctcactttgcttctccaacagcctgtcgagcggtagctgcccatcagctatttgatgccagtggccatggtctaaatgaagcagatgctgatttcctagatgacctgctctccaggcacgtgatcagagccttggtgggtgagagagggagctcttctgggcttctttctccccagagggccctctgcctcttggagctcaccttggaacactgccgtcgcttttgctggagccgccaccatgacaaagccatcagcgcagtggagaaggctcacagttacctaaggaacaccaatctagcccctagccttcagctatgtcagctgggggttaagctgctgcaggttggggaggaaggacctcaggcagtggccaagcttctgatcaaggcatcagctgtcctgagcaagagtatggaggcaccatcacccccacttcgggcattgtatgagagctgccagttcttcctttcaggcctggaacgaggcaccaagaggcgctatagacttgatgccattctgagcctctttgcttttcttggagggtactgctctcttctgcagcagctgcgggatgatggtgtgtatgggggctcctccaagcaacagcagtcttttcttcagatgtactttcagggacttcacctctacactgtggtggtttatgactttgcccaaggctgtcagatagttgatttggctgacctgacccaactagtggacagttgtaaatctaccgttgtctggatgctggaggccttagagggcctgtcgggccaagagctgacggaccacatggggatgaccgcttcttacaccagtaatttggcctacagcttctatagtcacaagctctatgccgaggcctgtgccatctctgagccgctctgtcagcacctgggtttggtgaagccaggcacttatcccgaggtgcctcctgagaagttgcacaggtgcttccggctacaagtagagagtttgaagaaactgggtaaacaggcccagggctgcaagatggtgattttgtggctggcagccctgcaaccctgtagccctgaacacatggctgagccagtcactttctgggttcgggtcaagatggatgcggccagggctggagacaaggagctacagctaaagactctgcgagacagcctcagtggctgggacccggagaccctggccctcctgctgagggaggagctgcaggcctacaaggcggtgcgggccgacactggacaggaacgcttcaacatcatctgtgacctcctggagctgagccccgaggagacaccagccggggcctgggcacgagccacccacctggtagaactggctcaggtgctctgctaccacgactttacgcagcagaccaactgctctgctctggatgctatccgggaagccctgcagcttctggactctgtgaggcctgaggcccaggccagagatcagcttctggacgataaagcacaggccttgctgtggctttacatctgtactctggaagccaaaatgcaggaaggtatcgagcgggatcggagagcccaggcccctggtaacttggaggaatttgaagtcaatgacctgaactatgaagataaactccaggaagatcgtttcctatacagtaacattgccttcaacctggctgcagatgctgctcagtccaaatgcctggaccaagccctggccctgtggaaggagctgcttacaaaggggcaggccccagctgtacggtgtctccagcagacagcagcctcactgcagatcctagcagccctctaccagctggtggcaaagcccatgcaggctctggaggtcctcctgctgctacggattgtctctgagagactgaaggaccactcgaaggcagctggctcctcctgccacatcacccagctcctcctgaccctcggctgtcccagctatgcccagttacacctggaagaggcagcatcgagcctgaagcatctcgatcagactactgacacatacctgctcctttccctgacctgtgatctgcttcgaagtcaactctactggactcaccagaaggtgaccaagggtgtctctctgctgctgtctgtgcttcgggatcctgccctccagaagtcctccaaggcttggtacttgctgcgtgtccaggtcctgcagctggtggcagcttaccttagcctcccgtcaaacaacctctcacactccctgtgggagcagctctgtgcccaaggctggcagacacctgagatagctctcatagactcccataagctcctccgaagcatcatcctcctgctgatgggcagtgacattctctcaactcagaaagcagctgtggagacatcgtttttggactatggtgaaaatctggtacaaaaatggcaggttctttcagaggtgctgagctgctcagagaagctggtctgccacctgggccgcctgggtagtgtgagtgaagccaaggccttttgcttggaggccctaaaacttacaacaaagctgcagataccacgccagtgtgccctgttcctggtgctgaagggcgagctggagctggcccgcaatgacattgatctctgtcagtcggacctgcagcaggttctgttcttgcttgagtcttgcacagagtttggtggggtgactcagcacctggactctgtgaagaaggtccacctgcagaaggggaagcagcaggcccaggtcccctgtcctccacagctcccagaggaggagctcttcctaagaggccctgctctagagctggtggccactgtggccaaggagcctggccccatagcaccttctacaaactcctccccagtcttgaaaaccaagccccagcccatacccaacttcctgtcccattcacccacctgtgactgctcgctctgcgccagccctgtcctcacagcagtctgtctgcgctgggtattggtcacggcaggggtgaggctggccatgggccaccaagcccagggtctggatctgctgcaggtcgtgctgaagggctgtcctgaagccgctgagcgcctcacccaagctctccaagcttccctgaatcataaaacacccccctccttggttccaagcctcttggatgagatcttggctcaagcatacacactgttggcactggagggcctgaaccagccatcaaacgagagcctgcagaaggttctacagtcagggctgaagtttgtagcagcacggataccccacctagagccctggcgagccagcctgctcttgatttgggccctcacaaaactaggtggcctcagctgctgtactacccaactttttgcaagctcctggggctggcagccaccattaataaaaagtgtccctggctcagagccctctaagactcagggccaaaaacgttctggacgagggcgccaaaagttagcctctgctcccctgcgcctcaataatacctctcagaaaggtctggaaggtagaggactgccctgcacacctaaacccccagaccggatcaggcaagctggccctcatgtccccttcacggtgtttgaggaagtctgccctacagagagcaagcctgaagtaccccaggcccccagggtacaacagagagtccagacgcgcctcaaggtgaacttcagtgatgacagtgacttggaagaccctgtctcagctgaggcctggctggcagaggagcctaagagacggggcactgcttcccggggccgggggcgagcaaggaagggcctgagcctaaagacggatgccgtggttgccccaggtagtgcccctgggaaccctggcctgaatggcaggagccggagggccaagaaggtggcatcaagacattgtgaggagcggcgtccccagagggccagtgaccaggccaggcctggccctgagatcatgaggaccatccctgaggaagaactgactgacaactggagaaaaatgagctttgagatcctcaggggctctgacggggaagactcagcctcaggtgggaagactccagctccgggccctgaggcagcttctggagaatgggagctgctgaggctggattccagcaagaagaagctgcccagcccatgcccagacaaggagagtgacaaggaccttggtcctcggctccggctcccctcagcccccgtagccactggtctttctaccctggactccatctgtgactccctgagtgttgctttccggggcattagtcactgtcctcctagtgggctctatgcccacctctgccgcttcctggccttgtgcctgggccaccgggatccttatgccactgctttccttgtcaccgagtctgtctccatcacctgtcgccaccagctgctcacccacctccacagacagctcagcaaggcccagaagcaccgaggatcacttgaaatagcagaccagctgcaggggctgagccttcaggagatgcctggagatgtccccctggcccgcatccagcgcctcttttccttcagggctttggaatctggccacttcccccagcctgaaaaggagagtttccaggagcgcctggctctgatccccagtggggtgactgtgtgtgtgttggccctggccaccctccagcccggaaccgtgggcaacaccctcctgctgacccggctggaaaaggacagtcccccagtcagtgtgcagattcccactggccagaacaagcttcatctgcgttcagtcctgaatgagtttgatgccatccagaaggcacagaaagagaacagcagctgtactgacaagcgagaatggtggacagggcggctggcactggaccacaggatggaggttctcatcgcttccctagagaagtctgtgctgggctgctggaaggggctgctgctgccgtccagtgaggagcccggccctgcccaggaggcctcccgcctacaggagctgctacaggactgtggctggaaatatcctgaccgcactctgctgaaaatcatgctcagtggtgccggtgccctcacccctcaggacattcaggccctggcctacgggctgtgcccaacccagccagagcgagcccaggagctcctgaatgaggcagtaggacgtctacagggcctgacagtaccaagcaatagccaccttgtcttggtcctagacaaggacttgcagaagctgccgtgggaaagcatgcccagcctccaagcactgcctgtcacccggctgccctccttccgcttcctactcagctactccatcatcaaagagtatggggcctcgccagtgctgagtcaaggggtggatccacgaagtaccttctatgtcctgaaccctcacaataacctgtcaagcacagaggagcaatttcgagccaatttcagcagtgaagctggctggagaggagtggttggggaggtgccaagacctgaacaggtgcaggaagccctgacaaagcatgatttgtatatctatgcagggcatggggctggtgcccgcttccttgatgggcaggctgtcctgcggctgagctgtcgggcagtggccctgctgtttggctgtagcagtgcggccctggctgtgcgtggaaacctggagggggctggcatcgtgctcaagtacatcatggctggttgccccttgtttctgggtaatctctgggatgtgactgaccgcgacattgaccgctacacggaagctctgctgcaaggctggcttggagcaggcccaggggccccccttctctactatgtaaaccaggcccgccaagctccccgactcaagtatcttattggggctgcacctatagcctatggcttgcctgtctctctgcggtaaccccatggagctgtcttattgatgctagaagcctcataactgttctacctccaaggttagatttaatccttaggataactcttttaaagtgattttccccagtgttttatatgaaacatttccttttgatttaacctcagtataataaagatacatcatttaaaccctgaaaaaaaaaaaaaaaaaa

SEQ ID NO: 45 - DNA, 2696 bp, Homo sapiens
gtcctggcttcagcttccaactacaaagacagacttggtccttttcaacggttttcacagatccagtgacccacgctctgaagacagaattagctaactttcaaaaacatctggaaaaatgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaagtgcta

SEQ ID NO: 46 - DNA, 429 bp, Homo sapiens
acacatctcactcatccttctactcgtgacgcttcccagctctggctttttgaaagcaaagatgagcaacactcaagctgagaggtccataataggcatgatcgacatgtttcacaaatacaccagacgtgatgacaagattgagaagccaagcctgctgacgatgatgaaggagaacttccccaacttccttagtgcctgtgacaaaaagggcacaaattacctcgccgatgtctttgagaaaaaggacaagaatgaggataagaagattgatttttctgagtttctgtccttgctgggagacatagccacagactaccacaagcagagccatggagcagcgccctgttccgggggcagccagtgacccagccccaccaatgggcctccagagaccccaggaacaataaaatgtcttctcccaccaga

SEQ ID NO: 47 - DNA, 5912 bp, Homo sapiens
gcttcggagtgtgaggaggacagccggaccgagccaacgccggggactttgttccctccgcggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgcatta

SEQ ID NO: 48 - DNA, 434 bp, Homo sapiens
acttccgctcgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaa

SEQ ID NO: 49 - DNA, 2319 bp, Homo sapiens
cagtcaaatttgcgcgggttggagcctggcgtagtcatggccgccttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagagatcctcaccatggagaaggaagtggcccagagccttctcaatgcgaaggagcaggtgcaccagggaggcgtggagctgcagcagctggaagctgggcttcaggaggctggggaggaggacacccgtctgaaggccagcctccttcagctcaccagagagctggaagagctcaaggagattgaggcggatctggagcgacaggagaaggaggtcgacgaggacacgacagtcacaatcccctcggccgtgtacgtggctcaactttaccaccaagttagtaaaattgagtgggattatgagtgtgagccagggatggtcaaaggcatccatcatggccccagtgtggcccagcccatccacctggacagcacccagctctccaggaaattcatcagcgactacctctggagtctggtggacaccgagtggtagccaggagcctcgtggctgcgtcttgcacccagcgggcatctgccgtggtcagatccatttcaaatgaaatgtggggacatagatctttttttttttttttttgagacagagtttcactcttgttgtccagtctggagtgcaatggcacaatctcagctcacagcaacctctgcctcctgggttcaagcgattctcctgcctcagcctccaaagtagctgggattacaggcatgcgccaccacacccagctaattttttgtatttggtagagatggagtttcaccatggtggtcaggctggtcttgaactcctgacctcaggtgatccacccgcccgccttggcctcccaaagtgctaggattccaggcgtgagccatcgtgcccagctagacgtcttccttttttttttttttttgagacggagtctcactctgtcgcccaggctggagtgcagtggtgcgatctcagctcactgcaagctccgcctcctcccgggttcacgccattctcctgcctcagcctcctgagtagctgggactacaggcacctgccaccatgcgcagctaattttttgtatttttagtagagacggggtttcaccatgttagacaggatggtctccatctcctgagtttgtgatctgcccgccttggcctcccaaagtgctgggattacaggtgtgagtcaccgcgcctggccttttttttttttttttttactggatttctttttctcctgattttcggcctcagctcctagagtggcctcagctaggtaaccaacgggagtcgacttatctatgccaggcctgcagtttcacatctgtgacgggatgggacaaatgacaccgtggtattcgatgacagctcccaggtacttcaaggttggcccttactcattcagggggtatgtttgagtgccacggtgtgcccagactctgctaggcaccagagagacaagatacgagtgacatggttctcctcccactgctgacggaggaattaacacaaaagcagacaacactctagaactggagagaggtccagattgcgacaggagccacaccagagtgtgcaggcttcatggaggacagaagcgacttttgtgccgggacttaaaaagataaggaggccaggtgtggtggctcatgcctgcaatcccagcactgtagaaggcagaggccggcagatcacttgagcccaggagttggagaccagactggggaacatggcaagaccccatctctacaaaaaaattaaaaaatttggcctggtgtggtggctcatgcctgtgatcctagcactttgggagttaaaatacaacacttcccagctgcccttatagttaaggtctggccagtgaaatgtatgtggaaatgttacatgacacttctagaaggattcttaaaagacaaatacaccctttcttcccccttcctatttcctggaatgtgggtgtgatggctggagccctggcagccatactgccacgtgtacagacgagtgccgtcctttagggatgacaggagcctggttccctgatgatggcagagccagatatcagcacaaacttatttaaatgggagagagaaggggagaaccaatctcaacttctaccttgtgtaagctgctggttttgggggttttctatgacagataccaaaataaaccctaactgaacatgtactcc

SEQ ID NO: 50 - DNA, 3477 bp, Homo sapiens
gatgctagcccgagagcgagcagaggagcagcgcacccgcacgagccttggaccctttggaaccgaaagcacgcccgtcctcagagtcccgtcctcaaagtcccatcctcgccatggcacccggagagaagatcaaagccaaaatcaagaagaatctgcccgtgacgggccctcaggcgccgaccattaaagagctgatgcggtggtactgcctcaacaccaacacccatggctgtcgccgcatcgtggtgtcccgcggccgtctgcgccgcctcctctggatcgggttcacactgactgccgtggccctcatcctctggcagtgcgccctcctcgtcttctccttctatactgtctcagtttccatcaaagtccacttccggaagctggattttcctgcagtcaccatctgcaacatcaacccctacaagtacagcaccgttcgccaccttctagctgacttggaacaggagaccagagaggccctgaagtccctgtatggctttccagagtcccggaagcgccgagaggcggagtcctggaactccgtctcagagggaaagcagcctagattctcccaccggattccgctgctgatctttgatcaggatgagaagggcaaggccagggacttcttcacagggaggaagcggaaagtcggcggtagcatcattcacaaggcttcaaatgtcatgcacatcgagtccaagcaagtggtgggattccaactgtgctcaaatgacacctccgactgtgccacctacaccttcagctcgggaatcaatgccattcaggagtggtataagctacactacatgaacatcatggcacaggtgcctctggagaagaaaatcaacatgagctattctgctgaggagctgctggtgacctgcttctttgatggagtgtcctgtgatgccaggaatttcacgcttttccaccacccgatgcatgggaattgctatactttcaacaacagagaaaatgagaccattctcagcacctccatggggggcagcgaatatgggctgcaagtcattttgtacataaacgaagaggaatacaacccattcctcgtgtcctccactggagctaaggtgatcatccatcggcaggatgagtatcccttcgtcgaagatgtgggaacagagattgagacagcaatggtcacctctataggaatgcacctgacagagtccttcaagctgagtgagccctacagtcagtgcacggaggacgggagtgacgtgccaatcaggaacatctacaacgctgcctactcgctccagatctgccttcattcatgcttccagacaaagatggtggagaaatgtgggtgtgcccagtacagccagcctctacctcctgcagccaactactgcaactaccagcagcaccccaactggatgtattgttactaccaactgcatcgagcctttgtccaggaagagctgggctgccagtctgtgtgcaaggaagcctgcagctttaaagagtggacactaaccacaagcctggcacaatggccatctgtggtttcggagaagtggttgctgcctgttctcacttgggaccaaggccggcaagtaaacaaaaagctcaacaagacagacttggccaaactcttgatattctacaaagacctgaaccagagatccatcatggagagcccagccaacagtattgagatgcttctgtccaacttcggtggccagctgggcctgtggatgagctgctctgttgtctgcgtcatcgagatcatcgaggtcttcttcattgacttcttctctatcattgcccgccgccagtggcagaaagccaaggagtggtgggcctggaaacaggctcccccatgtccagaagctccccgtagcccacagggccaggacaatccagccctggatatagacgatgacctacccactttcaactctgctttgcacctgcctccagccctaggaacccaagtgcccggcacaccgccccccaaatacaataccttgcgcttggagagggccttttccaaccagctcacagatacccagatgctggatgagctctgaggcagggttgagaagacagatctagtcaggaccaccagccatggtctaaggacatggatcgggtgcccccagacgtgtgcacaggggaccctctgccccactctgggcttttcagatactctgaccaaaaagcctgctttaaaccgcaagatggggcctgggcatgcgcaggaggagccatcgggtactacgcagcaacactcacaactgtccaggctgagataaatcccgggacctgaactattagcacgtcactagagactgggagccgaggcagtggtgctggcccaagtgaaggccagagtgaggactgatgcagctctttacgggtcttgagagggaaggactcttccaaagccccaaagccgagggtttcacccacactgccagcctgggttggggcccaaggatgtgaccttgagtgtcaaggctggacagctactgccagatgccaaagataggagaaagtgccagccctgaagctggagccgtttgtgaataaactgttcttcatcattgacactggagaaaggtgtcctccatgccctcaggcagcagagaactggcccagagcccttggagtgttggtggagatcagagtgccgtggtggaggtctgggactatgtcagagtgtcctcactttggggcatgggtgggtccaggagatggatttagttattcaattttgtggatgaataaattgaggcacagaaagattaagttaccggcccaaggtgacacagtgaggaggtggcagagctaggatttgaacccagacaatctgacttcatgattttgcatccaattcgtgtctgtgccttttaaagggtgaggtctgtgtcactttgggtggggagggggagcatggtgggccatgctctgggcagctgttccaagacagagctgacccttccattaccaatggcctgtccctcaccaacaagccaactgccacagatgacccacttcataccacattcacatctttccacctgaaatggctaacaggtattaaatccttggttggtgtttaaagccaacccaagaacagggtgttaggtactgttttaagcacctagataggttagcataggggactgcaaatggtgttccgcaaagcaaatcctgtttttgaccatgaactaagaattttattttattttattttttattttttgtagaaataggatctcactatgttgcccaggctgttcttgaactcctggcctcaaatgatcttcccacttcagcctcccaaagtgcagggattacaggcacaagccaccgtgcccagccaagaatttttatttttgcttttaaatagcaaaagaagaagattctgtgactcatgaaaatgatatgagattcgaattccagtgtctataaataaagttttattggtacacagccaca

SEQ ID NO: 51 - DNA, 4230 bp, Homo sapiens
aggcgggctccggcggcagcgacgcgagcgcggcgatggggagcggcggcgtggtccactgtaggtgtgccaagtgtttctgttatcctacaaagcgaagaataaggaggaggccccgaaacctgaccatcttgagtctccccgaagatgtgctctttcacatcctgaaatggctttctgtagaggacatcctggccgtccgagctgtacactcccagctgaaggacctggtggacaaccacgccagtgtgtgggcatgtgccagcttccaggagctgtggccgtctccagggaacctgaagctctttgaaagggctgctgaaaaggggaatttcgaagctgctgtgaagctgggcatagcctacctctacaatgaaggcctgtctgtgtctgatgaggcccgcgcagaagtgaatggcctgaaggcctctcgcttcttcagtctcgctgagcggctgaatgtgggtgccgcacctttcatctggctcttcatccgccctccgtggtcggtgagcggaagctgctgcaaggccgtggttcacgagagcctcagggcagagtgccagctgcagaggactcacaaagcatccatattgcactgcttgggcagagtgctgagtctgttcgaggatgaggagaagcagcagcaggcccatgacctgtttgaggaggctgctcatcagggatgtctgaccagctcctacctcctctgggaaagcgacaggaggacagatgtgtcagatcctgggcgatgcctccacagcttccgaaaactcagggactacgctgccaaaggctgctgggaagcgcagctgtctttagccaaagcctgtgcaaatgcaaaccagcttggactggaggtgagagcttccagtgagatcgtctgccagctatttcaggcttcccaggctgtcagtaaacaacaagtcttctccgtgcagaagggactcaatgacacaatgaggtacattctgatcgactggctggtggaagttgccaccatgaaggacttcacaagcctgtgcctgcacctgaccgtggagtgtgtggaccggtacctgcggaggaggctggtgccgcggtacaggctccagctgctgggcatcgcctgcatggtcatctgcacccggtttatcagtaaagagatcctgaccatccgggaggccgtatggctcacggacaacacttacaagtacgaggacctggtgagaatgatgggcgagatcgtctccgccttggaagggaagattcgagtccccactgtggtggattacaaggaggtcctgctgacgctagtccctgtggagctgagaacccagcacctgtgcagcttcctctgcgagctctccctgctgcacaccagcctgtccgcctacgccccagcccgcctggctgccgcagccctgctcctggccagactgacgcacgggcagacacagccctggaccactcagctgtgggacctcaccggattctcctatgaagacctcattccctgcgtcttgagcctccataagaagtgcttccatgatgacgcccccaaggactacaggcaagtctctctgaccgccgtgaagcagcggtttgaggacaagcgctatggagaaatcagccaggaagaggtgctgagctacagccagttgtgtgctgcattaggagtgacacaagacagccccgaccccccgactttcctcagcacaggggagatccacgccttcctcagctctccctcggggcggagaaccaaacggaagcgggagaacagcctccaggaagacagaggcagcttcgttaccacccccactgcggagctgtccagccaggaggagacgctgctgggcagcttcctcgactggagcctggactgctgctctggctatgaaggcgaccaggagagtgagggcgagaaggagggcgacgtgacagctcccagcggcatcctcgatgtcaccgtggtctacctgaacccagaacagcattgctgccaggaatccagtgatgaggaggcttgtccagaggacaagggaccccaggacccacaggcactggcgctggacacccagatccctgcaacccctggacccaaacccctggtccgcaccagccgggagccagggaaggacgtcacgacctcagggtactcctccgtcagcaccgcaagtcccacaagctccgtggacggtggcttgggggccctgccccaacctacctcagtgctgtccctggacagtgactcgcacacacagccctgccaccatcaggccaggaagtcatgtttacagtgtcgtcccccaagtcccccggagagcagtgttccccagcaacaggtgaagcggataaacctatgcatacacagtgaggaggaggacatgaacctgggccttgtgaggctgtaagtgtgtcagcacatttgccgcagtggatgtgtactgagggggctggaggcgaagggtgggagcatagcataggaacgctgcatagaccatggaggcctttgcgcagagagcagagaggatgacttgcggccaccaagtttctgtctccgcgggagtcccgtgcaagccatcagaatgttgaaatgagggtgaagagctcagatccctctctttggaaagtttagcctggaagcagttggccacactgtgtggagggcacctctctgtcccttccgtgtctcactgtctctggaagcttcagcccatgtgtgtcctggtgttcccagccccaccagagccccgtgccgggagctgacagctttcacgcttaaggcacgtgtgacctgggtagtcagacaccacttgagcccctgcccacatctgctggtttggggcttcagtggggagctgacagctgtgagcacaccactgtcccctcatccacctcggcctgcatggggcacccacttccttctgggtggggcttccatggtaagggggcctgcgtccctgcacactgcgaggactgccttggccacaggcccactccctacgacacgtgactcgttttagagctctgtcccagaggcgttcgtatgtgacccacagatggcgtcaatgtgaacacctctctttgtgctgaatttctgggccattcttttcctgtcttatttctaaatttccttcttccaagatgaaaacaaaagaaaaacttaaaacagaaggtattaaaaaaacaagagattcccaccattatttaggttcacctgcaaaacaaaaatcttactccagcccctcaatgccatcctgacacactttatgcaaaaagaattttcccagataggctagccagaaaaaacttcaagtcctctgtaacatctgaggtgaccaagaggcagaagagcagagcagtcgggggccgtgtcctggctgatcccaactgcagctctgctgtgggggcccgtgggagggaggcagacccctgggctttcctgctggccacggagactctgctcctgcatggaaagggagcctgggagccagcagcccacgcctggggagcctgcctggggccatgtgaccatggcctctccctgggaacgggctgaccacaacacaccctgctgccatccacttctgtttactctgcaaatgtaagaaagaaccacttggccagaagtgtcccccagatgcttttttttttttttttttggagacagttttgctcttgtctccccggctggagtgcagtggcatgatctcaactctcaactcactgtaacctccgcctcccggatactcctgcctcagcctcctgggtagctgggattacaagcacccaaccacgcccagctaatttttgtattttcggtagagacgggatttcaccatgttggccaggctagtctcgaactcatgacctcaagtgatccgcccacttcggtctcccaaagtgctgggattacaggcatgagccacggcgcctggcccccaaatgctcttgaaccggaaacccagggatgggagatgctcactgagctgctgcttttatgtgtgctggtgctatgtgtgttcatgtccgcggcagctgtctttttgctactataagggaattctggccaccctgggtggggtgtggtcggggtgagaacccaagcgttggaactgtagacccgtcctgtcgactgtgtgcccctgggcatgtgtgagcctcagtttcctcatctgtaaggggggcaatgatacctacctcacaggggtgttgtgaggattaaatgtgaggaggatagtggca

SEQ ID NO: 52 - DNA, 1361 bp, Homo sapiens
gcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 53 - DNA, 4440 bp, Homo sapiens
gccgcctcctgggaagatggcgctgcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccagggtactgtggaacactgcataataggagtaataatcctttctgaattgactcaggaaatgaacctggttgattattctagaccttcagcaaaacacaggaaaatagctacctcatttcgtgatacttctctcaaagacgttttagtgctagcatgctctcttttaaaagaggtgtttgccaaacctttaaatcttcaggatcaatgtcagcaaaatctggtaatgcaggtcttgaaactggtccttaactgccttaactttgacttcattggcagttcagcagatgaatctgcagatgatctttgcacggtgcagattccaacaacttggagaacaattttcctggaaccagaaacattggatcttttcttcaatttgtatcattcacttccaccactactatctcagttagcactttcatgtttagttcagtttgcttcgacaagaaggtccttatttaacagtcctgaacgtgccaagtaccttggtaatttaattaagggagtaaaaaggatacttgaaaaccctcagggtttgtctgatccaggtaattatcatgaattttgtcgatttttggctcgtttaaagacaaattatcagctgggagaattagttatggtgaaggaatatcctgaagttattagattgattgctaattttaccattactagcctacagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggacgtcttgcatggctggtatacttagttgggacagttgtaggaggaagattaacatataccagtacagatgagcatgatgctatggatggagaattatcctgtcgagtttttcagcttatatctttaatggataccggattgcctcgatgttgtaatgagaaaatagagcttgcaattctgtggttcttggatcagtttcgtaaaacatatgttggtgatcaacttcaaagaacctcaaaggtatatgctcgtatgtcagaagtcttaggaataacagatgacaaccacgttctagagacgttcatgacaaaaattgttacaaaccttaaatactggggaagatatgagcctgtaatttcaaggactcttcagttcctaaatgacctttctgttggttatatccttttaaaaaaacttgtgaagatagatgctgtgaaattcatgctaaaaaaccacacgagtgaacacttcccttttcttggcatcagtgacaatcatagtctcagcgacttcaggtgtcgaacaaccttctacacagcgctcactcgccttctgatggtagatctgggtgaagatgaggatgaatttgagaatttcatgctgcctcttacagttgcttttgaaacagtattacaaatattcaacaacaactttaaacaagaagatgtaaagcgtatgttgatcgggctggcaagagatcttcgagggattgcctttgcactgaacacaaagaccagctacaccatgctgtttgactggatgtacccaacgtaccttccccttcttcagaatgctgttgaacggtggtatggagagccaacatgtacaactcccatcttgaaacttatggcagaacttatgcaaaacagatcccagcgtttgaattttgatgtatcatctcctaatggaattcttctcttcagagaagctagtaaaatggtttgcacttatggtaatcagatcctgtcccttgggagcctctcaaaagatcagatttatccaatgaaactcaagggcatctccatctgctattcagctctcaagtctgccttgtgtggaaattatgtcagctttggcgtcttcaagttgtatggggacaaccattttgacaatgtactccaggcttttgtcaaaatgctgctgtcagtgtcccacagtgacttgctacaataccggaaactgagccagtcttattatccactcctggaatgtctcactcaggaccatatgagcttcatcatcaacttagagcctcctgtactcatgtatgttctcacatctatctcagagggactcactactcttgatacagttgtctcctccagctgctgtaccagtttagactacatcgtcacctacctcttcaagcacatagcaaaagagggcaagaagccacttcgatgcagagaggctacccaggctggtcagagactattacattttatgcagcaaaacccagatgtcctgcagcagatgatgtctgtcctcatgaacaccattgtctttgaagactgtcggaaccagtggtcagtatccaggcctctcctggggctcatcctgctcaatgagaagtatttcagtgaactgagagcaagtttgataaacagccagcccctccccaagcaggaggtccttgcccagtgcttcagaaacctaatggaaggagtggagcagaacctgtccgtcaagaacagagacaggttcacccaaaatctgtctgtattcagaagagatgtggcagaggcgttgcgcagtgatggcaacactgaaccatgcagtctcgacatgatgagctgacccgacttttctgaccatgtgcggagcagcctttatcaagagactcctgaaggtctgggtctcaggacagtgatgttggctagcccaggggaatgtatttttcaaaacatacaagcaacagcaaaagccctaacttcttatacgtctagcctaattataagaatttctaacagtaccagtgtaaattcagtcttttctctgaaaagcaaaggatgtgttttcagtctttctatcaaatattatctttgttctcctaatgctctgaaaggatgtagaaacaatatttaaccaaagaacgtaataaaccaggtttgcacctaagtgtgtactagtttatggttctgcagtcaaggttgtcaatttgttggagatgcagccttcaccatggatcctggattgagacgaatgccattggaacctgttaaatgagtagtttgttatgtgtctggaagaagcagcgttagggactttgggctgtgagcatttagaacgagcctggaagcactacagagcatcccacaggaccacacgcaggcctccctgcctcagctgcatctgataaagttgagagacagtaacacaattaaatgacttagaaacaatgtttgcttttcactggcataaatctgaagtggttcagtctagaagaattaagctgtgcaattactgcctgcagagatatttcttcaggaggagtcatgtagccccagtcagaagttctgggtggtgccagcacccagtcctctgcctccatttaatttttaagagaaggtgaaggtaactattagaatataatatttgaagcagctctgccttcttagggctacccaaaacagttctaggtgctaaaattcagattttcagaggatgagaaatagctggtttccaactctccacaaaaactcttattactgttgggacttgggattctgactcaccccaaacccagaacatgaagaagacctttacagtttgtgctctactgttactaggctattaatttgagatcgtccactgtcaagtgttttactatctcactgctgtttttatgattcaggcttataacaaatattgtatcctttatttctgataagacatgaaaggttggccttactgttgaacaataagtaaatccacaggctcctgttgtaatctca

SEQ ID NO: 54 - DNA, 2058 bp, Homo sapiens
aaagagaggctggctgttgtatttagtaaagctataaagctgtaagagaaattggctttctgagttgtgaaactgtgggcagaaagttgaggaagaaagaactcaagtacaacccaatgaggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaattgatcatcatagcatctactgcataattgcagtatgtagtgtatttttaatgctaatcaatgtcctggttatcatcctaaaaatgttctggattgaggccactctgctctggagagacatagctaaaccttacaagactaggaatgatggaaagctctatgatgcttatgttgtctacccacggaactacaaatccagtacagatggggccagtcgtgtagagcactttgttcaccagattctgcctgatgttcttgaaaataaatgtggctataccttatgcatttatgggagagatatgctacctggagaagatgtagtcactgcagtggaaaccaacatacgaaagagcaggcggcacattttcatcctgacccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattctaaattctggaagcacgtgaggtaccaaatgcctgtgccaagcaaaattcccagaaaggcctctagtttgactcccttggctgcccagaagcaatagtgcctgctgtgatgtgcaaaggcatctgagtttgaagctttcctgacttctcctagctggcttatgcccctgcactgaagtgtgaggagcaggaatattaaagggattcaggcctc

SEQ ID NO: 55 - DNA, 2999 bp, Homo sapiens
gatcaactatccacgctgctcgaatcacagcatgctggagggcctggctgggtgctctgactgactgatcacctgacagacggtgcggtcagtcggatgctgagaatgactgacgatgtgatgaggggcggattgaacgagtcacaggccagctggccaggagcaaaatcggcatagctgtctgactcgatggctgtacgtggttacggactgtctgccctgatagaatctcagcttcaacgcatcagaggagactgacttgaccaatggtggggatgagtcgcctgagaaatgacagactggctgacccactgacaggctgcagcgtgtgttgcaagtcttcttggaatcagctgcaggacctgtgccgcctggccaagctctcctgccctgccctcggtatctctaagaggaacctctatgactttgaagtcgagtacctgtgcgattacaagaagatccgcgaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagaggcgggcgctccgtcgctgggagcaggagctcaatgccaagcgcagccatctgggacgcatcactgtagagaatgaggtggacctggacggccctccgcgggccttcgtgtacatcaatgagtaccgtgttggtgagggcatcaccctcaaccaggtggctgtgggctgcgagtgccaggactgtctgtgggcacccactggaggctgctgcccgggggcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggagtacgtgggagagatcattacctcagaggaggcagagcggcggggccagatctacgaccgtcagggcgccacctacctctttgacctggactacgtggaggacgtgtacaccgtggatgccgcctactatggcaacatctcccactttgtcaaccacagttgtgaccccaacctgcaggtgtacaacgtcttcatagacaaccttgacgagcggctgccccgcatcgctttctttgccacaagaaccatccgggcaggcgaggagctcacctttgattacaacatgcaagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaagggggtccctgggctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctgccttcacagtgcagtgaaggtacctagggctcttgggagctctgcggttgctaggggccctgacctggggtgtcatgaccgctgacaccactcagagctggaaccaagatctagatagtccgtagatagcacttaggacaagaatgtgcattgatggggtggtgatgaggtgccaggcactgggtagagcacctggtccacgtggattgtctcagggaagccttgaaaaccacggaggtggatgccaggaaagggcccatgtggcagaaggcaaagtacaggccaagaattgggggtgggggagatggcttccccactatgggatgacgaggcgagagggaagcccttgctgcctgccattcccagaccccagccctttgtgctcaccctggttccactggtctcaaaagtcacctgcctacaaatgtacaaaaggcgaaggttctgatggctgccttgctccttgctcccccaccccctgtgaggacttctctaggaagtccttcctgactacctgtgcccagagtgcccctacatgagactgtatgccctgctatcagatgccagatctatgtgtctgtctgtgtgtccatcccgccggccccccagactaacctccaggcatggactgaatctggttctcctcttgtacacccctcaaccctatgcagcctggagtgggcatcaataaaatgaactgtcgactgaacaaaaaaaaaaaaaaaaaa

SEQ ID NO: 56 - DNA, 1389 bp, Homo sapiens
ggacttctgccaagcaccggctcatgtgaggctcgcggcacagcgttctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcaagagaaatatgtgttaaattcactcgtggtgtggacttcaattggcaagcccaggccctattggccctacaagaggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggctatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatgaaaa

SEQ ID NO: 57 - DNA, 2473 bp, Homo sapiens
gacaccactggccgcgaagcgcagggggggcgcgcgcgctgccgcccgttcccagcacttgtgcagactcctccggggaagagcggcctccgcggtcatctccaacggaattctgcctttgaagtgtcggggcacggcgcgtcgagggtcctggcggccaggcggggcgtgtgcaagggtcgcgtcccccccccgggcccccggcccgtggctcttggtagagcccagtgcttcatttcccgtgcgcggcccgggcggccctccctttcatcagtcttcccgcgtccgccgattcctcctccttggtcgccgcgtccttggctggcgttagagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggccctctg

SEQ ID NO: 58 - DNA, 3157 bp, Homo sapiens
agtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacgaaggagagatccaggactcctccatgaagcccgcggacaggacagatggctccgtgcaagctgcagcctggggtcctgagcttccctcgcaccgcacagtcctgggagccgattcaaaaagcggtgaggtcgatgccacgtcagaccaggaagagtcagttgcttgggccttagcacctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccagaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaatttttagggttctctttgataggcctgtttttctgatgtgtgtgttttttttgggggggggttatttgtttgtttgtttgtttgtttgtttgtttttgagacagtctctctctatcgcccaggctggagtgcggtggcacaatcttggctcactgcaacttccgcctcccgggttcaagcgattcttctgcctcagcctcccgagtagctgggattacaggcgcgcgccaccacgcctggctaatttttgtagttttagtagagacggggtttcaccatattgaccaggctggtctcgagctcctggcctcgtgatccatctgcctcggcctcccaaagtgctgggattataggcgtgagccactgctcccagccgtgtgttcttttttaaatttagatatgtccagagaatcctctctcctgtttcccatttcattcgagaatattgtttgcttgtgagacgtaagttcgagccctgcatgcaatgacccttgaaggaaaataaacagtcctggtggtcccagacgctcctgcagccacagcgcctgtgactcctcatgattcttactgaagctgttgatgacaggatatcatggtgacgtttttgtaatgaaatatttcacatattcagaatacattggtgaaactcatgctggagtaaatagttaatatatggcca

SEQ ID NO: 59 - DNA, 4587 bp, Homo sapiens
gtcatagaagactactcggagagcgctgcctctgggttggcgggctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatgcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcaggttttagctgaaaaggttcatatgagagctatgtccattgctcagagagtaatgctccttcaacaaggtcttaatgacagatcagatgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaagaaaaaaactgctggctgttttacaggagattcttattttacccacaatcccaatatccctggtttcttttcttgttgaaagactactccacatcattatagatgataataagagaacacaaattgttacagaaattatctcagagattcgggcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaagaatgatgctgaaacattgcagaaatgtcttattttatgctatgaactgttgaagcagatgtccatttcaacaggcttaagtgcaaccatgaatggaatcatcgaatctttgattcttcctggaataataagtattcatcctgttgtaagaaacctggctgttttatgcttgggatgctgtggactacagaatcaggattttgcaaggaaacacttcgtattactattgcaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatgaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaatcagaacaaacctgatgtctttctgaagattttctgctgtgcgcttccacgttactttggcctgtattaaagcagtagagcagcatcagttattatagtccagaaaaagtgtgcatcagtcagtcacacagatttatcacaatctgaggtgggcctaggaatctcatttttaaatagtctctccaagtgattcttatgaactctttatgtttaaaatcatgtcattatggaaaacttacaagtgtaactagctagtagcttgcatttgagaagcttatgacttagatgggcagaatcaacaaagatgaaaccgcctgaggacacatttaacaagtaacatttctagggaaaatgaaggaagtaccacaaactggctagaaaggagcttatcaatcaccagtgaggaagaccagtataacgttcaacaacagttattttgacaaaaacttattttgtgattcctacagtgaaaacatttttggtgatatctgcctgggaaatctctcttcctaaagtatttgtatatgggagtccttgtttgtgaatgtttcctggattagggaggtgtcaacataaatgtattattaaccatgaagctgctcgctatatttttggcataacaaaataatatttatttactgtggataataattctagtgggaatataatgtgacaggaacttctctttatatacgctaccaatttatgagcactattcactgtcaatttcatttcttgtcttttgaaattgacacttggcctgacttacgaaacttgtactatatgaaattggtcctcttttctgcaatacccaacgaaacaccttttctctttattattcagaaatgtcctaacatggatctgtttgttttaataattgtgctttttttaggcttatcatctactagaggccatttacttaaggtgaaattttaagatggagctaaagtaagatcactggtttttagaaccaaattgctatacatatgtgcctcatagaacttataaaaggagtcaaagtttcaaagcaagatagttattaagcaaaaggaaaaatggtaatgatagaaagtcagttaaaaatagatgattgttcttcattctgtttgttggctctgtgttctcctgtgcttcagattccttatgtgttgttgttttaaagacaatttgcagggggttgggagaaggactgaaaaggtacattaagtgtgctgtaaggaaaagtcttagaaacataataagctaaaatcccattcacacatggccaggctatccaaaaagaaaggagccatgttctcatgtggtttaccataccaaagcttgctttctctggcatgggaaaaataaatttaagcaccaaa

SEQ ID NO: 60 - DNA, 3749 bp, Homo sapiens
aggggcgtggccacgtcgaccgcgcgggaccgttaaatttgaaacttggcggctaggggtgtgggcttgaggtggccggtttgttagggagtcgtgtacgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgagtgaagccatgtccctggagggagatgaatgggaactgagtaaagaaaatgtacaacctttaaggcaagggcggatcatgtccacgcttcagggagcactggcacaagaatctgcctgtaacaatactcttcagcagcagaaacgggcatttgaatatgaaattcgattttacactggaaatgaccctctggatgtttgggataggtatatcagctggacagagcagaactatcctcaaggtgggaaggagagtaatatgtcaacgttattagaaagagctgtagaagcactacaaggagaaaaacgatattatagtgatcctcgatttctcaatctctggcttaaattagggcgtttatgcaatgagcctttggatatgtacagttacttgcacaaccaagggattggtgtttcacttgctcagttctatatctcatgggcagaagaatatgaagctagagaaaactttaggaaagcagatgcgatatttcaggaagggattcaacagaaggctgaaccactagaaagactacagtcccagcaccgacaattccaagctcgagtgtctcggcaaactctgttggcacttgagaaagaagaagaggaggaagtttttgagtcttctgtaccacaacgaagcacactagctgaactaaagagcaaagggaaaaagacagcaagagctccaatcatccgtgtaggaggtgctctcaaggctccaagccagaacagaggactccaaaatccatttcctcaacagatgcaaaataatagtagaattactgtttttgatgaaaatgctgatgaggcttctacagcagagttgtctaagcctacagtccagccatggatagcaccccccatgcccagggccaaagagaatgagctgcaagcaggcccttggaacacaggcaggtccttggaacacaggcctcgtggcaatacagcttcactgatagctgtacccgctgtgcttcccagtttcactccatatgtggaagagactgcacaacagccagttatgacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaagccgagctattgaccagtgcagagaagagagcagaaatgcagaaacagattgaagagatggagaagaagctaaaagaaatccaaactactcagcaagaaagaacaggtgatcagcaagaagagacgatgcctacaaaggagacaactaaactgcaaattgcttccgagtctcagaaaataccaggaatgactctatccagttctgtttgtcaagtaaactgttgtgccagagaaacttcacttgcggagaacatttggcaggaacaacctcattctaaaggtcccagtgtacctttctccatttttgatgagtttcttctttcagaaaagaagaataaaagtcctcctgcagatcccccacgagttttagctcaacgaagaccccttgcagttctcaaaacctcagaaagcatcacctcaaatgaagatgtgtctccagatgtttgtgatgaatttacaggaattgaacccttgagcgaggatgccattatcacaggcttcagaaatgtaacaatttgtcctaacccagaagacacttgtgactttgccagagcagctcgttttgtatccactccttttcatgagataatgtccttgaaggatctcccttctgatcctgagagactgttaccggaagaagatctagatgtaaagacctctgaggaccagcagacagcttgtggcactatctacagtcagactctcagcatcaagaagctgagcccaattattgaagacagtcgtgaagccacacactcctctggcttctctggttcttctgcctcggttgcaagcacctcctccatcaaatgtcttcaaattcctgagaaactagaacttactaatgagacttcagaaaaccctactcagtcaccatggtgttcacagtatcgcagacagctactgaagtccctaccagagttaagtgcctctgcagagttgtgtatagaagacagaccaatgcctaagttggaaattgagaaggaaattgaattaggtaatgaggattactgcattaaacgagaatacctaatatgtgaagattacaagttattctgggtggcgccaagaaactctgcagaattaacagtaataaaggtatcttctcaacctgtcccatgggacttttatatcaacctcaagttaaaggaacgtttaaatgaagattttgatcatttttgcagctgttatcaatatcaagatggctgtattgtttggcaccaatatataaactgcttcacccttcaggatcttctccaacacagtgaatatattacccatgaaataacagtgttgattatttataaccttttgacaatagtggagatgctacacaaagcagaaatagtccatggtgacttgagtccaaggtgtctgattctcagaaacagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggtagacctgtttggtatagcagatttagcacatttactattgttcaaggaacacctacaggtcttctgggatgggtccttctggaaacttagccaaaatatttctgagctaaaagatggtgaattgtggaataaattctttgtgcggattctgaatgccaatgatgaggccacagtgtctgttcttggggagcttgcagcagaaatgaatggggtttttgacactacattccaaagtcacctgaacaaagccttatggaaggtagggaagttaactagtcctggggctttgctctttcagtgagctaggcaatcaagtctcacagattgctgcctcagagcaatggttgtattgtggaacactgaaactgtatgtgctgtaatttaatttaggacacatttagatgcactaccattgctgttctactttttggtacaggtatattttgacgtcactgatattttttatacagtgatatacttactcatggccttgtctaacttttgtgaagaactattttattctaaacagactcattacaaatggttaccttgttatttaacccatttgtctctacttttccctgtacttttcccatttgtaatttgtaaaatgttctcttatgatcaccatgtattttgtaaataataaaatagtatctgttaaatttgtgcttctaaaaaaaaa

SEQ ID NO: 61 - DNA, 3932 bp, Homo sapiens
ggatccacggccgcacagctaaacagcaaccccctacccgcttcgtctccctccgccgctatcggggcctaagcgggagcggctggcacggcgtcactgggtgggctggggcggaagtggaggcggagggagacggtggcgtcgtccgcggggccctgggctctcgcggcgaggccctggtgggcgcgaggcagggggagggggaggaggaggagcccgcggcccgggcggcggcggctctcgggttctccgtagggccccgcctcggagcgggcggcggcggaggaggagactgaggagcaggatggcggcctcggccctgtacgcctgcaccaagtgtacccagcgttatcctttcgaggagctctcccagggccagcagctctgcaaggaatgtcggattgcacatcctattgtaaaatgtacttactgcagatcagaatttcaacaagagagcaaaactaacacaatttgtaagaagtgtgctcaaaatgtgaagcaatttgggacgcccaagccttgtcagtactgtaacataattgcagcatttattggtaccaagtgtcagcgttgcacaaattcagaaaaaaagtatggaccacctcagacctgtgaacagtgcaaacagcaatgtgcttttgatcggaaggaggaaggaagaagaaaggttgatggaaagttattatgctggctctgtactttatcgtacaaaagagttttacagaagacgaaagaacaaaggaagagcctgggatcttcacattcaaattcatcttcttcatctcttactgagaaagaccagcatcatccaaaacatcatcaccaccatcatcaccatcaccatcgtcacagcagtagccatcacaaaatcagcaatctaagtccagaagaagagcagggactgtggaaacagagccataaatcctctgcaacaattcagaatgaaactccaaagaaaaagcccaaattggaatctaagccatctaatggagatagtagctctataaatcagtcagcagatagtgggggaacagacaattttgtccttataagtcaattgaaagaagaagtgatgtcacttaagcgtctcttacagcagagagaccagaccattttagaaaaagataaaaagttaactgaactaaaggcagactttcagtaccaagagtcaaatttgagaacaaaaatgaacagtatggaaaaagcccacaaagaaactgtggaacaacttcaggccaaaaacagagaactactcaaacaggtcgcagcattatcaaagggtaaaaaatttgacaaaagtggaagcatactaacatctccttgagaaagtcatttgtttagcatttcttcttacaatgtaaatttggggaaaaaaaattctgtgaagcccttaaattctgtgtagtagaaaaatatttttgcacaccaaatgaattggtgtgtttcctgttcacttttgtaattgatatacagcattttttaagttgtaaaacattcaaataaaacttcaactggtttgaagtaactttttaattatttgatatccaggaacttttttgccagcaatagtattaaacagttgtaaaggagtgcatgagtagtgctctttatgaaacgcaacatgcaataatagagtaggtatggtttcagaagtcagagcagcagggtttttttgttttgtttttgttttacactatgctaatttcagacaaacagttttcaatttagaaatacaaaaacttttaaactcgaaaaatggcgaacactggttttttgggaattgtgtttttactttgcatcaagatgaatttaggagaaaatcacggtgcttttattaaatgaacttcagatatatgtaaatttgttttttaaagttacatcattaacattagtaacctagcattttcattattggtataggaattaatgtttattgtacagtatctaaggtaaaatgtgtttctgttttgtaaaaactactgtagatttttacttacaagtgcctttttgccacctaatgtttttatttataggaatgctgatcttttgtacatacattttgttttaaaatcatgtttaataaatgtttgtatataaatgcatatgtacagaagcctatttcaaaaggaaatcaaagttgctagtaaaatgtttgagattacatttagaactaactgataatgcatatagattgtagaaaattttgtgatttgtttctgtgtgataagggaagctgttggtctttgaattcatttaattatgtcaaaatagttccccaaagatttaattttaagttgcttcttaaagagtaattttattttttatgtcatgtggcttcatattagtattgtgtgagttacatgttttgctttatattttataaaattttttaaaaattttaatgtttctgcaatgatccatgtatctgctttccctatgtgtggttatctaagttaatatttatgtacaatgtaatttgtaaatttaaagcaaatctgaaaaaaattaaatgatctttttaatccaatctgtgataatctttgaataaattggaatctactataagattcaggcattataagtaaattgtcctaaagtctttaaaattgtctataaaaggttaaggtagggtgggataggttatatgaagttattgactatattctgatccagcggttttcagcctgaaatagaatttatctcctagttattatcagttcagagttttagtttgattttaaagtattgctagatacactgtatagagtgagttgcttctcttaataatttatgggcaaagataaatttgcttcatgtaaaactgttactaaatttataagttttaaaggttttgttttatacaagcattgattgtgaatgtcatatcaaagattggctttcttaagaacacatgattgaaacaatttttttttaacatgacgtgtttcaatagactgttctcatagttcattataaagtgaataccaaataattctttgtccattttgaaagcataatatagggtaattttcaagtgatacaaaaagattcagttagaatcttgtaaactaaaccagtttatttttatgggatcttcatgtaataattttcttaaatttagtactctcaaccatgatagataatgccttaacatggattttaacgtttgcaggatttgctaaattcataagatagttattacctttctttgaaatttgtaatgttttatattcttgtttcatagccatttgtcagtccacagtggtcattatggttttactttttgatagttcttacaccttgttggagaaactacaaaagaaagttgtcctcgtccttccccttagctaacatcaaaattaaaaagttgaatattaatattagctaacattaaaatggaaggtaattcagttttagtgttagctaacattaacagtctaataatttagctttgtaaattccaaggctaaaaccctttcatgggcttcacagtatttagtcctaattaaatacccttctttattccatgaccttattttataacttaaatttttttgcaattgtataaattagtaattcagtcccagtcctggatctctgtagtgttttgacataataaactgatattctttaaatgtggacctgtaaggagatactatggtgtggtgtattgtgcttttagcctgttttccactattaattagcatttaccagtaagggtcattttgactcaagttatttatgtattaatagcctgtgaatattgcagtcctttttagattatattggtctaaatatgcattctgcagtgaacctgttaagctgttcacatgtatagactattgaaatactgtacttgtacacatctgactgttgacattttgtacttttttctagatccaatatttcacaataaaaaacttgtcaaaggc

SEQ ID NO: 62 - DNA, 1419 bp, Homo sapiens
gcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaagacaaacaagactccagtggggtggtcagtaggagagcacgttcagagggaagagccatctcaacagaatcgcaccaaactatactttcaggatgaatttcttctttctgccatcttttggaataaatattttcctcctttctatggaaatctgggctcggtgtttgtaaagttcatttttataagcttttctatcgctacataatgcctttttaaaaaatgattttgtagtctaaacttaggttgagtatataaaccctgccatgtagcttgagatgcctgaaaagactggtaagtgcgtttcttaatcgttcagtaactatttgagtgcctactgcagccaaggcactggagggatcaaagatgtgtaaatttggagtccctgcaagttcacaagctatttggagagataaggttagtatacatagaactgtaatataaggttgtgttggagcattgtccttaaagatggtaccatggtgagcagttcaaggttacctgccagctgcagaacaaggcagcaaatgctcctgagatggaaccatcacagcctcagacataggactaaagaagtcaagagtgattaaaaagccaggggcaggagacagtaattttgtatttcagtagcaggcatctcgatacactaatttgagagctttattacttttaagaaattaaaaattaaaatgaacctaaattttca

SEQ ID NO: 63 - DNA, 5160 bp, Homo sapiens
aaaacccggaggagcgggatggcgcgctttgactctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccactgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagcagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgagttatcatgaattttaaagtatgcattattaaattgtaaaactccaaggtgatgttgtacctcttttgcttgccaaagtacagaatttgaattatcagcaaagaaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtataatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaaggaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgaaaaaa

SEQ ID NO: 64 - DNA, 5617 bp, Homo sapiens
agttgctggggtaaggcacgtgaggaggaggtggcttgaggcaaccatggcgggaggaatgaaagtggcggtctcgccggcagttggtcccgggccctggggctcgggagtcgggggcggtgggacagtgcggctactcttgatcctctccggctgcttggtctacggcacagctgaaactgatgtaaatgtggtcatgcttcaggaatcccaagtttgtgaaaagcgtgccagccaacaattctgttacacaaatgtgcttatcccaaaatggcatgatatatggacacggatacagatccgagtaaatagttccagattggttcgagtcacccaggtggagaatgaggagaaactgaaggagctagagcagtttagtatctggaactttttttcctcctttttaaaagagaaattgaatgacacctatgttaacgtgggtctatacagcacaaaaacctgcctcaaagttgagattatagagaaggacaccaagtacagtgtcattgtgatccggagatttgatcccaaactctttcttgttttccttcttggacttatgctatttttttgtggagacttgctgagcagaagtcaaattttctactactctactgggatgactgtgggaattgtggcctctctgctaatcatcatttttatactatctaagtttatgcctaagaaaagtcccatttacgtcatcctggtgggaggctggtctttttctctgtacctcattcaactagtttttaaaaatttacaagagatctggaggtgttactggcagtatcttttaagttatgtcctcacagttggattcatgagttttgcagtatgttacaagtatgggcccttggagaatgaacgaagtatcaacctgctgacctggaccttgcagctgatgggcctgtgtttcatgtattctggcatccagataccacatattgcccttgccattatcatcattgctctttgtactaagaacctggaacaccctattcagtggctgtacatcacctgcagaaaggtgtgtaagggagcagaaaagcctgttccccctcgtctcctgacagaagaagaatatcggatacaaggagaggtagaaacccgaaaggctttagaggagctccgagaattttgtaacagtccagactgctctgcttggaagactgtttctcgaatccagtctccaaaaagatttgctgactttgtggaaggctcttcccacctcacgccaaatgaagtttctgtccatgagcaggagtatggattagggagcattattgcccaggatgaaatctatgaggaagcatcctctgaggaggaggactcatattctcggtgtcctgctatcacacagaacaactttctaacctaggtagtggtcagttatctttacgtggactggcttggtgccttggtccatgttgcatgtgttgtgcaattgctttcaaccctttgaaacagagtgagatagatagggtagaaattctcctactgaaataagaggcctaaaaaggcctccctttggaaatgggaggtctctatgggatccctgaggaaggagagtggataaagtagtgaatgctgggtagttcacttcccattggttaagctaacagcccacttttatgtttccagagaaattggatggccacagctagcatggcattctagctccttcttgaaagttgattcaatcatggcatttctgtcactggctggctctccaaagtaagaactgttgttaagtgcaggaatgcttttagactataggctgcaacttccagagagaaatccacaaatctgagcctccttcactccagcttttatttcagtgactttagaataattattgatttaactgttttgggaggaaaatagatttttattgttttgttttttaaatgaatgtcttttaaaaaacataacaaactcatgttccagaaccagcaagtgctccagagtgacacaccccctaggcccctacatatttattaatatggattatccattaaagccccaggagctgttgttttaagctttgatttagttctcatacatatgatagaaagtcctatttgcctttaggaacatgcctgtaggctcttctgcaggtgagatgtactgggctttttattatattcaactttcaattccatcttaaaaaacatttgtattcttctcttcccattcttccttaccctgcctttgccctttcaggaagggtcagttcccttacctgtgaactatgtatgttcagagtagcattattcctgctagctaggagaagtcatcttgtttaggggatttggatgctttttatacgttctccattttcctgtcattgggtcatgttatctttgagttgctatgaaatcaggaaactgtctccttttcctttcccttcctttgtctacatgctctgtccattcctttcagccttttctcaccacccatactcccccaaatctgggtaatttttaagccttgaaactatgtagtttcttgatacacaatttgtagttatgcagcagccacaatttgcattgccaggaaataggctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctccattgcagacttccaaagggtcagctctgagactgccctccaggtgggcagttgattatttccaccagtgttttccagagccttaaactgtcctaagtgacaactacctcagttggcaggaaagagacatatagtagaaagtgaaaaatgagcagtatttgggcagatgctatgggttacagttgaagggtaaaaggaactttacattgggaaacctttatacccttgtgaattatgtacatggtaaaatgttctctctctacaaagaactattaaaacttctgaaatatactattttttaccttatttatagaaattgagacctagcatatttaagcataagtttattttaaaaaataattcaactcgtgcaagtggtctcaggattctctggagattttggtgcctcccctacttagggaggtgatagcttgcctataagggtgacttttcctgatcatgtctttatttcaatgagaaagcactgtgaaattgtgaaagattctcctctttctctgtttaataaacccccatgaaatatagtttccatctctagaccagttttttttccaccgtgtttagacttgaggtgaataaaatcaaactgttttttactccctatctggtagttggagacctgagctgtaggcagtggagatggcaattggttctgcagcctgagagttgctctcacacagtgaaggacggtgctgctctggtgtgctgtgtgtccttgccctgcctgcctgtggctctgcccagatgcttcagatcctctgtgttccggagattgcttgacttcaaccttctttaggagctgctcttgtctccctcttggccacttagtttgctggctcagtcactacttgaagaccccatttaatttttctctggcagttatagctcttgtgatttcagtacagtctcatctctcagaccaatctcatcaagaaggattgaagggataactatgaggtaagctggacattggagccgtgtttgctgccacgtcagcgtcttgctgggtgaatgtcaagccataaatgggctccagggctctggatctcatcagcattggaaatctattgcctctcatcagtctgaccaaattatgtagagcattaatgtagagactcccattaatgggaatacaagaggcagctggcataaaacatttctttcactttcctttcccactcagattgcttcaagagaccaacagaacacagggatcaaaaacaaggaaaatttagcaacttcattaccttctaataagtaattcctgttagccactgcatcccaccaaaactagtttatttttcccctcaaattcatgatttttacgtctgttacaaagggaattttgctgatagctctttgggtcccactgttccattttatgctaatagattccattctagggcccagccgtctcttgactgatggtgttccctttaacccttggcatgtataatagaattttggtgaatgaaagaacccaaataggccagatagtccccccaggccctgatatccataaaaggcttgggaatgcattatgtaattgtccttagtctttttgttgttttagaaaaaaaaaacaagatgggctcagatggatgcctacgtaaaaatggttcctagctgtgtactcataacttttctttgaattgagtagtgaaaggaaggaggaggaaaggaaattaaatgtccttctagtattctctggactcaagtctgacatatgagataataacctatattgaaatgccaagaattgtatctgaaacaagagaacagtttgacacatttatcatgccttcatattacatattaactgaaaccaattaataaacatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctgggaataaacaaagcagattcatgccaacaccaactcgtagctttagtggcagatgggagtggtcacagactcccaaaatgtggggctttggatttccacaccatcccacgtgtgtgtcatcttcctctttcacactcttgatgataatttgaaaatggtgaaatcacctctgaatttgcctatagcatgagcacattcttatgacaacataacaaatagttcataatgtgaatattagaaactgttacagcctgcagttaccataattttccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagttttatagata

SEQ ID NO: 65 - DNA, 2126 bp, Homo sapiens
aaattcgaacggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaagtgta

SEQ ID NO: 66 - DNA, 4388 bp, Homo sapiens
agggcggcgggaggcccagggagaacggggaagggacatttagtttgagacggtgctgagataggatcatgaaggaagaggtgaagggaattcccgtaagagtggcgctgcgttgtcgccctctggtccccaaagagattagcgagggctgccagatgtgcctttccttcgtgcccggagagcctcaggtggtggttggtacagataaatccttcacctacgattttgtatttgatccctctactgaacaggaagaagtcttcaatacagcagtagcgccactcataaaaggtgtatttaaaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgagaggatcctaaggaaggcataaagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagaatagcagctttcgctccaagctgcatcttgtagacctcgctggatcagaaagacagaagaaaaccaaggctgaaggggatcgtctaaaagagggtattaatattaaccgaggcctcctatgcttgggaaatgtaatcagtgctcttggagatgacaaaaagggtggctttgtgccctacagagattccaagttgactcgactgcttcaagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtacaacagctacaagtcttgttgctacaggcccatggaggtaccctgcctggatctataactgtggaaccatcagagaatctacaatccctgatggagaagaatcagtccctggtagaggagaatgaaaaattaagtcgtggtctgagcgaggcagctggtcagacagcccagatgttggagaggatcattttgacagagcaagcgaatgaaaaaatgaacgccaagctagaagagctcaggcagcatgcggcctgcaaactggatcttcaaaagctagtggagactttggaagaccaggaattgaaagaaaatgtagagataatttgtaacctgcagcaattgattacccagttatcggatgaaactgttgcttgcatggctgcagccattgatactgcggtggagcaagaagcccaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggataacataaaagagctagaattagaagtcatcaatctgcaaaaggaaaaggaagaattggttcttgaacttcagacagcaaagaaggatgccaaccaagccaagttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacggatgatgaaaaaccagcgggtacagttaatgcgtcaaatgaaagaagatgctgagaagtttagacagtggaagcagaaaaaagacaaagaagtaatacagttaaaagaacgagaccgtaagaggcaatatgagctgctgaaacttgaaagaaacttccagaaacaatccaatgtgctcagacgtaaaacggaggaggcagcagctgccaacaagcgtctcaaggatgctctccagaaacaacgggaggttgcagataagcggaaagagactcagagccgtggaatggaaggcactgcagctcgagtgaagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccggaggcgtacattctcccttactgaagtgcgtggtcaagtttcggagtcagaagattctattacaaagcagattgaaagcctagagactgaaatggaattcaggagtgctcagattgctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgaccctcctccaggtagccagcagacagaaacatcttcctaaggatacccttctatctccagactcttcttttgaatatgtcccacctaagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaagggtgttcctgcaagggctggtgtggaaacaagcagtgtgggtgcaggaagcaaaagtcagactgtggtgtggactgttgctgtgaccccacaaagtgtcggaaccgccagcaaggcaaggatagcttgggcactgttgaacggacccaggattccgaaggctccttcaaactggaggatcctaccgaggtgaccccaggattgagcttctttaatcccgtctgtgccacccccaatagcaagatcctgaaagagatgtgcgatgtggagcaggtgctgtcaaagaagactcccccagctccctccccttttgacctcccagagttgaaacatgtagcaacagaataccaagaaaacaaggctccagggaagaaaaagaaacgggctctggccagcaacaccagcttcttctctggctgctcccctatcgaagaagaggcccactgaagttggagtcatcatctctacccccagtctggcttgggagatgctttcaggttgcagccagaaggggttttttaaatgacttctctggatttcaggtttcttgctgttgaaaaaaggaacaaagcgttactgaaaagaaggtaacctttgttggatgtgggccttagcctccaggtccagactactactctatgttctccagaagggtgctaagtcacctactgaagagagaaccaactgactttcctattgactcatcaggaaccagtcctcagtctggtcaagttgtttcttatttgtgagcagttcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgttgaagcaaatgaattatttttaaatgttaagtaagtaaataaaccttagcccgtctactgtttgggaagatccttctgtgctagagggagaaataaaatttcaacctgtgttcctca

SEQ ID NO: 67 - DNA, 1243 bp, Homo sapiens
agttgtttgcgggcggccgggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttccgtgcccatgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactca

SEQ ID NO: 68 - DNA, 2029 bp, Homo sapiens
ggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaa

SEQ ID NO: 69 - DNA, 2862 bp, Homo sapiens
aaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaa

SEQ ID NO: 70 - DNA, 6030 bp, Homo sapiens
gttacggcgctcaggcgtctcgacgcgcgcgatttaaaaccagctcaggagacgccaaggaaagatgggacctcccggcccagcactgccagccacaatgaataactcttcttcagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatagaactggcaaaatatttgagtgtccactagatgagtatcagacctagtccttacccttagggggatgcagtcctggttgttatccaggatacacacctgtcagtataaggcagaagatgcctaagggccaagatggtttgcctcggaggagaatggaagagagagattgctgactggacattcagatgcaagactgggtcctgcttaaatcccaggattctgctggagggagctgatagtgatacttgtcccttctgtacattgcttcatgtagccttctcagcatccctaggagaaacttactattgtgactctcatgttggaggaggaaacggacacccaaggtagaggaacttgcaaaagggcagccggcaaactgtcaggggtggcctgagcctggcaatctgcctccagagtctgctctcggccattgtgctatgtgctacctggataggtcatacaggctcagcagtgggtggagagcagtgctcagatttgtccatctccacagaatgcagcacacacacaaatgtacaagttcttcccctaacctcagaggaataggggaattaactttgcttgcaatttggaacaatattatagatgttgatccaagtagttctgttactggctggtcctggatctctgccagaacacccgtcatcattgactggctaaatagagatcttggatataggccagaagcagtgaagtatataattggaaattgctcctgataataacttccttcttagccaaaaaccacacaaaacaaaaataatcccctccccacaggaatatgctttccaaattgtgtccaaaacattacctgctctgttatattgagaaggttagagacttcagagcatgcttagaaaaagcagtggtgccacaggtgagactccacactctgtcttgctggggctgaagcctccatcactttcccaggccaggttagtgctgggcttcttgctttccttctattcctgagagtagaactggctaagcccattccttccctcagtcagccccacttctctatagtgggttctgggggtggggggctgaattaccagtaaaactagaaagattgggaccaagtgcagtggcccacacctgtaaatcctagcgctttgaaaggaagaggcaggaggattgcttgaagtcaggagttcaagaccagcctgggcaaaatagaaccccatctttaaaaaaaaagtttaaaaattagccaggtacggaggtgtgtgcctgtaatcccagctactcagaaggctgaggtgggataatcacttgagcccaggagtttgaggctgcagtgagctgtgatcacactactgcattccagccaggacaacagagtgagatcctatctcttaaacaaaaaaaaaaactggcgagttcaataccaacttctacaatgaaatccccttccccccacaaccctgcttctcctaagtttccctcattacatggttgctgtgggctatgtgtgctgtggtctgaatgtttgtgtctaaaattcacatgttggtattaagagatagggcctttgggaggtgattaggttatgagggcagatccctcgtgaatgggattagtgctcttataaaagaggcctgaggaagcttgttcgttcctcttgcccttctgccatgtaaggatgcaatgagaaggcaccatctgtgagcaaggagcccctcaccagacagcaaatctgccggcgtcttgatcttggacttctcagcctctagaactgtgaacaataaatctattgtttataaattaagcagtctaagtcattttgttatagcagacaaattgactaagacagtgggtatgcaagataagtttattttatataaaatactttgggaagtaggtgttctaggactggtgtgacagttccatgaaattatgagagaccggggatccttccagctcatccttctgtttcagtgtggctgctggaatccagccatcacatccatagtctaagcagcaggacgaaggactgggggaaaagagaactgctgctccctgttaaatcagtttcctgggggtcgatatgaatatttgccacctcagggtgccacaaaggtccccaccagcaagaaggctcccaccagatatggactcaacctgggacttttcagcctccataactgtaataaattcctttgtcagttacccagtttcaggtattctgttataggtaacagaaaacaaactaatacaagtggtaatgtgtccagctaaaaatttgggttctgttaaggttaaaagaaaatttgaggtagccagcagtatctgcctcagatgctgagaagcctcctgagataagagcgtataccatgtccataactgaagttttaacattctctgccaaacagaaccagaatttaagggcaggagaatttgcaagatagaatttgcaatttgcaagagggaattgcaatttgcaagagaggggcaatttgcaatttgcaagagagggcaatttgcaagagagaattgtggggccctgagagagaatacatccaaaggaagagggaaccaggcattacaaattgaattgaacaaggacagatatctgaagggggtttgtagttcccagtaaagtatggtacagctaggtgcacttccctggccagaccaccctacagtgtatgatccccctggggagcaaaaggctgcaggtaacactttggtgccctagaaattctgctgtggtgcaactatagtggatcacaggcagagtggggcattgttccccttcttagcacaggatactgggtcatttcaacaccacaaggatttgcagcatctgcggcaacgagtttggtgtcctggagcaaggaaaggaaccgttcatggtggctgaagccaagctgctcagcactgaggcagcaagccatgatctaggtcttcgagtagaattctcagttttggttcatttaaaaatgttttttgggggaattggggatcatttatgggtaccaaaagaaaaaaaaatgaataagatctactatttgatagcacaatagggtgactatagtcaataataacaattgtatattttaaaataaagaatgtaattgaaaagagtaaatgcctgaggggatggataccccattctctgtgatgtgcttatttcacattgcatgcctgtatcaaaatatctcatgtaccccataaatatatgcacctactatgtacccacaactatttaaaaaataataaaattttaaaaaattgtc

SEQ ID NO: 71 - DNA, 6424 bp, Homo sapiens
gccccagctgccgcccgccggctcgcccgtgcagctgcgatgccccggagcgtcgaccccggtcctggtccctggcccgccgcgtaattagcctccgcgcgcccagagcgcgccgccgccaacgccgcgcccgacgcagcgatgggcaacacggtgcaccggaccctgccagacccgagcccaccggcgcgcctcctggccacccggccgtgctgcggccccggccccgagcgacgcccggtcctgggcgaggcgccgcgcttccacgcgcaggccaaaggcaagaacgtgcggctggacggccactcgcgccgggccacacggcgcaacagcttctgcaatggcgtcacgttcacgcagcggcccatccggctgtacgagcaggtgcggctgcgcctggtggccgtgcgccctggctggagcggcgcgctgcgcttcggcttcaccgcgcacgatccgtcgctcatgagcgcccaggacatccccaagtacgcctgcccggacctggtcacgcggccgggctactgggccaaggcactgcccgagaacctggcgctgcgcgacacggtgctggcctactgggccgaccgccacggccgcgtgttctacagcgtgaacgacggcgagccggtgctcttccactgcggcgtggccgtgggcggcccgctctgggcgctcattgatgtctacggcatcaccgacgaggtgcagcttctggagagcgccttcgctgacacgctgacgcccgcgcgcctcagccaggcccgcttcagcgcctgcctgccgcccagcagccacgacgcggccaacttcgacaacaacgagctcgagaacaaccaggtggtggccaagctgggccacctggcgctgggccgcgccccgggcccaccgccagccgacgccgcggccgccgccattccgtgcgggccccgtgagcgcccgcggcccgcgtcgtcgccggcgctactggaggccgacctgcgcttccacgcaacacgcgggcccgacgtgagcctgtcggccgaccgcaaagtggcctgcgcaccgcggcccgacggcggccgcacgctggtcttctccgagcgcccgctgcggcccggcgagagcctcttcgtggaggtgggccgtccggggctggcggcgcccggcgcgctggccttcggcatcacgtcgtgcgacccgggcgtgctacggcccaacgagctgcccgccgacccagacgcgctgctcgaccgcaaagagtactgggtggtggcgcgcgccgggcccgtgccgagcggcggcgacgcgctcagcttcacgctgcggcccggcggcgacgtgctcctgggcatcaacgggcgtccgcgcggccgcctgctgtgcgtcgacaccacgcaggcgctctgggccttcttcgccgtgcgcggcggcgtcgcgggccagctgcgtctcctcggtaccctgcagtccagccctgcgaccacgactccatcagggtccctcagcggctcccaggacgatagtgattcagatatgaccttcagtgtcaaccagtcctcctcggcatctgagtcatccctggtgacggcccccagctccccgctgagccccccggtgtcccccgtgttctccccaccggagccggcaggcatcaagaatggcgagtgcacggtgtgcttcgatggcgaggtggacacggtcatctacacgtgtggacacatgtgcctgtgccacagctgcggcctgcggctcaagcgacaggcccgggcctgctgccccatctgccggcggcccatcaaggacgtcattaagatctacaggccatagcctagcctgcccacgggccttggccggtgcaaggtcacctttctgaaggccccctgggctgggcaaccacatggctgccagggagtccacgggcagcggccatctctccagtggtgggcaaggtgtgacagtcgtggagcgaggcccacagggcctcagcccaggcaggggttgcttctggctccaaagtgctttgcccccaaaaggccgtcccaagagcaagctcaggaactgcctggcagatcaccctgtcccttggtgacctttcaactgggaaacagcgtcctctgtctgtgcaatgcttcttgctggggttgggttgagtgtgagagaaggggaggggagggagggagaacagagagaatgtgtgtgtgagagagagagagagagaatgaacgtgtagcgattttaccaggggtcccggctccgggaggagacgtgcaatccggagccccgacattggcatgactagaagttgttcactttctggggatgggacataagctggttttgaatgtatgaagctgaccctcacagaactccctggggtggtgtagaaaagagatgctcagattttctaaggggaggcaaaaataactcattgtttacagctccaaagcatgaactccttgaggggaaggtgggtgaagaacaattcacttcttcatttcttactgggtcttagagctgggtgtgatgggcaccgaggccaacccctctggattgtgtcatcttttcaccccttcacccccagactgtctaataatacacacatcataccttgtctccgtctctggaggcaagtctctgtaatgcccttccctatctccaaggagaagaccagcagtaagttctgtttttctgtgggagagaaagaatcctagaggcaggtgacccacctggagctggaaagcccactccacgatgcagacagctctctaccttcctgtggtggcccctgggcctggcattcccaggggacctgctggcaggaggaggaacgagggctttataactttggttataacttttggtctttgttctgattctcagtgtatcttcctccgctggttactaaagtgttcactgataagtatgttaactaatgatcgagacagtaacgaaaaatgctggcactgggattctctcccttcccagacctacctgctggtatttcctgggaccttgaccctgccccaccccctcagccgtgcccatctctgcagactcccagatcacatctgggctgatgggctggcccaggcctgtccctcccttcttgcccccagttctgggctccacctctgccctcttctgtgctgtcccattagggaagtcccttggcctgtctatttttcagttcccaattagaagtctagaacctgacaactccaggagttcttgggaggaccagtacaacgttctaaaaagcctgagacgccttacaaaaagcaagtatcatttggagtacaattcctaatctgttcatgtcctgctgaaggagggaaggagggagaggaaggcaggggagttgatgcattcatataacaaacactgctgggtgtctgggtgcccagagcaaagctgggccaggccttcaccagatcaagccccacagaccagctggtgcccatgcgctgctggtggtttggggcctcctgttcctcctctagctgggagtaatcacagttgtctgacctgattccaacttaaggtccccactctcttgccccatcaagaatccctgattatttacttttccctagaaaatctggggaaattcccacattttaattttgcagcagaatcttttgagcagcttttggaaccacagtgtttgccaagataagagtttgagaatccagcagccctgggtgcctggctgaatttggtttcctgcatgtgctgggtgtgggcggggccacgcacaggccctgcatgggaggactcctcaccccaggcctgtggtgctgcagacaaccgtctcctgtctacactgcgacccagccacaagctgtggggtctcagtggcctgggggaaagcagctccactctcctgcccttcctggctgcccctttgggttccagccggggtcacgtccagcctccactgggaaaccagtgactgaggcctggacccagaggtggaccaggcatctcctggccacctgtgacctgggaagaagcgagtcagtggcccgttcaacctgctctgcagctgctataaatagcctccctgtttccaagaggaggtaaggaagtgtttatcttctaaaaaccagacgtttcctgatgctctgagcgttactcagtgctacagaggagatgcacacgtccccactatgttctgtcttgagaaggggacaagagaaagaggaaaaggagccactgtactttattttgcacctacagcgtgccttggcactgggctagagaggcaccttcctgcgtgaatcctgtgcggcaggtcttattgccataataagtcacatcaaagacactgctggtcataaaacactgttttacataccatagggaaaaacgctgccaatcttaactaagatgctacaactgtacagttccttccaatcagagatgttcacgtgtgaaaaaaaaactgtgctacttacaatctatgaaagctggtgttatcccacttggcaggtaaggaaactgaggtcctgtgagtgaagtgacctcatgatcacacaacaggagatggcagggctgggattcaaacccgggagtgtctgctgccacatcccacactcccactgcctggctccaagtcccaggaagctcgagactgtgagttttctcccttgaaactcacctggagagagtccgggcacctgtgcctatgtggagggttccagccccagccaggcccctccgctgcccacaccctgggaggagaagcggcctcccttccaggctcatctgctcactgcccgcattctcctggcagagctgaggtctgagagatctggactccaacccaagggccctctcttgttattcaggggtgtccacagttaggaagggacctggggccttgtcccaccaccttcctaggccccgtgatcaccaccccctcaagcggggccccagccccctgagcaccccctcacgtgacccagccctcggctgttccaggctcactgcccatggtgtgctcttctgggccacagcagccagggctccagggcgaggacaggggacacctgaaaacaccccgttgttcatggtcttgtgcccattcattcggagactcctgaaaaactgggctgtttgcaaagcaaatccagctccttgtcctagcaggttctcagaacggggagtcccctgggatggagctgctcccctcacggcagcaccacgtttccagtccctcgatgccactaatcagcatggactgtgttcaggacacagggtgaacttttctctgacccccggtgctggtcctgtgccagcacgtagtagttactcagtagaggtttgctgagtaaaccagaaatcagattatgagtgttcaggggtttgataaaacagcaccacataacgcacacaaagatactccagaaacatttgctgagtacctagtacgtgtgaggtgctgtgaggatagagcagagaggactgtgccccagctgtgatgctggcagaggtgacactaagagggaaatgagatatttggggcagaatccactgggctctcttggccatccgctgccttgggtctgttgaggtgggtgcccaaaggctgccttcttgaccagaacctgctgtgcgcttcacagaacctcctcttcattggaaatgctgggcacattgcagtcagtgagctgctgccaaaacggcgttaagtagaacccccagaggccccgccggttggtgatcaccctcaggtcctgccagggagacacagtgaggaggttggctaattgctgctttcaggccctggaaatcagtcgccaaggcccaggagaaccccggtgagtccgtccagttgaggcagaggcaataacctcccattgctcggccctgcgcctgccccagtcctggcagggggcaccggctcaggaacatgcggcctcctggcatttctcggtatttaactgtctcgctgtcttatccgagtccctaatgaaacgacttgtgtgacaatctgtctgtgccttacgaaagtgtctgtgcactttttatcctttttaaaagcaacttttaaaagtggatggggaggggggctagcatacgtggtagggttctagaaatctgtggtcatcgctgaaatcctttttgcatcatgttttttgatgttggagtgatgaagtgtacatcccccaccccacacaccactacctgtgtacagaccttttaaaacatgtcttctttttctgattcaatactgtgacctctccgatacagtctaatccttggggatctgtaatcaaggttttaaaacctgggaagtgggttgggaagggtttgcactggtcttgagtgttgtgcttttctgtgttgtgtgttttgatttttgtctttttatctgttttatattgacataattttcctgtttaaaaaaatacaactttggcttgttaaaaaaaaaaaa

SEQ ID NO: 72 - DNA, 10863 bp, Homo sapiens
agagtcaaaacgccatacttgtttggctcctctttttaatttgcgagtttattgggcttgttttctgttttctagggagtaggttagtggaaaagaaaaagggccgaattcactcccacgacctctacagccgcccctgaggggaagcggtcagcgtaagtcccggatccccgctccggagccgcctcgtgggagcggggcaaggagatccaggaggggtctcgaatctgccatggcgaaccggcgagtggggcgaggctgctgggaagtgagcccgaccgagcggaggccgcccgcggggctgcggggccccgcggccgaggaggaggcgtcttccccgccggtcctgtctctcagccacttctgcaggtctcctttcctttgcttcggggacgttctcctgggagcctcacggacgctgtctctggccctagacaaccctaacgaggaggtggcagaagtgaagatctcccacttcccggccgcggacctgggcttcagtgtgtcgcagcgctgtttcgtgttgcagcctaaagagaaaattgttatttctgttaactggacaccactcaaagaaggccgagtaagagagattatgacatttcttgtaaatgatgttctgaaacaccaagctatattactaggaaatgcagaagagcagaaaaagaaaaagaggagtctttgggataccattaaaaagaagaaaatttcagcctctacaagtcacaacagaagggtttcaaatattcagaatgttaataaaacatttagtgtttcccaaaaagttgacagagttaggagcccactacaagcttgtgaaaacttggctatgaatgaaggcggtcccccaacagaaaacaattctttaatacttgaagaaaataaaatacccatatcacctattagccctgctttcaatgaatgccatggtgcaacttgcttgccactctctgtacgtcgatctactacctactcatctcttcatgcatcagaaaatagggaactattaaatgtacacagtgccaacgtttcaaaagtttcttttaatgagaaagctgtaactgaaacttcctttaattccgtaaatgttaatggccaaagaggagagaatagtaaacttagtcttacccccaactgttcttcaactttgaacattacacaaagccaaatacattttctaagtccagattcttttgtaaataatagtcatggagctaataatgaactagaattagtaacatgtctttcatcagatatgtttatgaaagataattcacagcctgtgcatttggaatcaacaattgcacatgaaatttatcagaaaattttaagtccagattctttcataaaagataattatggactaaatcaggatctagaatcagagtcagttaatcctattttatcccctaatcaatttttaaaagataacatggcatatatgtgtacatctcagcaaacatgtaaagtaccattatcaaatgaaaattctcaagtcccacagtctcctgaagattggagaaaaagtgaagtttcgccacgtattcctgaatgtcagggttcaaaatctcccaaagctatttttgaagaactagtagaaatgaagtcaaattactacagttttataaaacaaaataatcctaaattttctgcagttcaggatatttctagtcatagccacaataaacaacctaagagacgtccaatactttctgccactgttactaaaaggaaggccacctgtaccagagaaaaccaaactgagattaataaaccaaaagcaaaaagatgtctcaacagtgcagtgggtgaacatgaaaaagtaataaataatcaaaaggaaaaagaagattttcattcttatcttccaattatagatccaatattaagtaaatctaagagttataaaaacgaggtaacaccctcttcgacaacagcttcagttgctcggaaaagaaagagcgatggaagcatggaagatgcaaatgtgagagttgcaattacagaacatacagaagtgcgagaaatcaaaagaatccatttttctccctcagagcctaaaacatcagctgttaagaaaacaaaaaatgtgacaacacccatctcaaaacgtattagcaacagagagaaattaaacctgaagaagaaaactgatttatcaatattcagaactccaatttctaaaacaaacaaaaggacaaaacccattatcgctgtggcacagtccagtttgaccttcataaaaccattaaaaacagatattcccagacacccgatgccatttgctgcaaaaaacatgttttatgatgaacgctggaaggaaaagcaggaacagggcttcacttggtggttaaattttatattaacccctgatgacttcactgtaaaaacaaatatttctgaagtaaatgctgctactcttcttttgggaatagagaatcaacataaaataagtgttcctagagcacctacaaaagaggaaatgtctctcagagcttatactgctcggtgtaggttaaacagactacgtcgtgcagcatgccgtttgtttacttctgaaaaaatggttaaagctattaaaaagcttgaaattgaaattgaagctaggcggttaattgttcgaaaagatagacacctatggaaagatgtgggagaacgtcagaaagtcctgaattggctgttgtcctacaatcctttgtggcttcgaattggtctagagacaacttatggagaactcatatctttggaagataacagtgatgtcacagggttggctatgtttattctgaatcgcctactttggaatcctgatatagcagctgagtatagacaccccactgttcctcacctgtatagagatggtcatgaagaagctttgtccaagtttacattgaaaaagttattgttgttggtctgttttcttgattatgctaaaatttccagactcattgatcatgatccttgtctcttctgtaaagatgccgaattcaaggctagtaaagaaatccttttggctttttcacgagatttcctaagtggtgaaggtgacctttcccgtcaccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcaggttgctttggaaaatagcgtttgcttttcaggtggatatttcccttaacttagatcaattaaaggaagaaattgcctttctaaaacacacaaagagtataaagaaaacaatatctctactatcatgccattctgatgatcttattaataagaaaaaaggcaaaagggatagtggttcctttgaacaatatagtgaaaacataaagttattgatggattgggtaaatgctgtttgtgccttctataataaaaaggtggagaattttacagtgtctttctcagacggccgtgtgttatgttacctgatccaccattaccatccttgctatgtgccatttgacgctatatgtcagcgtactactcaaactgtggaatgtacgcaaactggttcagtggtattaaattcatcatctgaatctgatgacagttctctggatatgtctcttaaagcatttgatcatgaaaatacttcagagctatacaaagagctcctagaaaatgaaaagaaaaattttcacttggttaggtctgcagttagagaccttggtggaatacctgctatgattaatcattcagatatgtcaaatacaattccagatgaaaaggtggttattacctatttgtcatttctttgtgcaaggcttttggatcttcgtaaagaaataagagctgctcgactcatacaaacaacatggagaaaatataaactaaaaacagatctcaaacgccatcaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcagggatattggagaagatattccactagacaaagatttctgaaattgaaatattattcaatcatcctgcaatctaggataagaatgataattgctgttacatcttataaacgatatctttgggctacagttacaattcagaggcattggcgtgcttatttaagaagaaaacaagatcaacaaagatatgaaatgctaaaatcatcaactcttataatccaatctatgttcagaaaatggaagcaacgtaaaatgcaatcacaagtaaaagctacagtaatattgcaaagagcttttagagaatggcatttaagaaaacaagctaaagaagaaaattctgctattatcatacaatcatggtatagaatgcataaagaattacggaaatatatttatattagatcttgtgttgttatcattcagaaaagatttcggtgctttcaagcccaaaagttatataaaagaagaaaagagtccatactaaccatccagaagtactacaaagcatatctgaaaggaaagattgagcgcaccaactatttgcagaaacgagctgcagccattcaattacaagctgcttttaggagactgaaagctcataatttatgtagacaaattagagctgcttgtgttattcagtcatactggagaatgagacaagacagagttcgatttttaaaccttaagaagactattatcaaatttcaggcacatgtaagaaaacatcaacaacgacagaaatataagaagatgaagaaagcagctgttataattcagactcatttccgagcttatatttttgccatgaaagttctagcatcttaccagaaaacacgctctgctgtcattgtgctgcagtctgcatatagagggatgcaagccaggaaaatgtatattcacatcctcacatctgttataaagattcaatcatattatcgtgcttatgtttctaaaaaggaatttttgagcctaaaaaatgctacaataaaattgcagtcaactgttaagatgaaacaaacacgtaaacaatatttgcatttaagagcagctgcactatttatccagcaatgttaccgttccaaaaaaatagctgcacaaaagagagaagagtatatgcagatgcgggaatcttgtatcaaactgcaagcatttgttagaggataccttgtccgaaagcagatgaggttacaaagaaaagctgttatttcactacagtcttatttcagaatgagaaaggctcggcagtattatctgaaaatgtataaagcaattattgtcattcagaattactatcatgcatacaaagcacaggtcaatcagaggaagaacttcttgcaagtcaaaaaagcagctacttgcttgcaagcagcttacagaggttataaagtacgccagctaatcaaacaacaatctatagctgctcttaaaattcagtctgcttttagaggctataataaaagggtaaaatatcaatctgtgcttcaatctataataaagattcagagatggtacagggcgtacaagactcttcatgatacaagaacacattttttgaagacaaaggcagctgtgatttccctccagtctgcttatcgtggctggaaggttcggaaacagattagaagggaacatcaagctgccttgaagattcagtctgcttttagaatggccaaggcccagaaacagtttagattgtttaaaacagcagcattagtcatccagcaaaatttcagagcatggactgcaggaaggaagcaatgtatggagtatattgaactccgtcatgcggtactggtgcttcaatctatgtggaagggaaaaacactgagaagacagcttcaaaggcaacataaatgtgctatcatcatacagtcatactatagaatgcatgtgcaacaaaagaagtggaaaatcatgaaaaaagctgctcttctgattcaaaagtattatagggcttacagtattggaagagaacagaatcatttatatttgaaaacaaaagcagctgtagtaactttacagtcagcttatcgtggtatgaaagtgagaaaaagaataaaggattgcaacaaagcagcagtcactatacagtctaaatacagagcttacaaaaccaaaaagaaatatgcaacctatagagcttcagctattataattcagagatggtatcgaggtattaaaattacaaaccatcagcataaggagtatcttaatttgaagaagacagcaattaaaatccaatctgtttatagaggtattagagttagaagacatattcaacacatgcacagggcagccacttttattaaagccatgtttaaaatgcatcagtcaagaataagttaccatacaatgagaaaagcagctattgttattcaagtaagatgtagagcatattatcaaggtaaaatgcagcgtgaaaagtacctgacaattttgaaagctgttaaagtccttcaggcaagttttagaggagtaagagttagacggactcttagaaagatgcagactgcagcaacactcattcagtcaaactacagaagatacagacagcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgtacagaacatatattacatttcagacttggaaacatgcttcaattctaattcagcaacattatcgaacatatagagctgcaaaattacaaagagaaaattatatcagacaatggcattctgctgtggttattcaggctgcatataaaggaatgaaagcaagacaacttttaagggaaaaacacaaagcttctatcgtaatacaaagcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccaccttagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgtaaagtgatttttgctctccgtgtacaacttttaaaatctgactttgttttaaaaaaacataaactgttcattacattcttcatttttatcatttatagttttatgcatgtaataaactaatatgtcataagatga

SEQ ID NO: 73 - DNA, 1805 bp, Homo sapiens
gcagagctctgtgctccctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcatgaaatgttataagtagacatacattttgggattgtgatcttagaggtttgtgtgtgtgtacgtatgtgtgtgttctacaagaacggaagtgtgatatgtttaaagatgatcagagaaaagacagtgtctaaatataagacaatattgatcagctctagaataactttaaagaaagacgtgttctgcattgataaactcaaatgatcatggcagaatgagagtgaatcttacattactactttcaaaaatagtttccaataaattaataataccta

SEQ ID NO: 74 - DNA, 3859 bp, Homo sapiens
ctaggcggcggcggccgggtccccaaggctgggcgctgcttgcggaaccgacggggcggagaggagcgtggcgggaggaggagtaggagaagggggctggtcaagggaagtgcgacgtgtctgcggagcctttttatacctccttcccgggagtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaaaatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaaaaaaaaaaaaaaaaaa

SEQ ID NO: 75 - DNA, 2661 bp, Homo sapiens
gagacgcagccgcggcaggccagcggggagatgctgccccggaggctgggagcgggaaggcggctgcgggcgcagcggcctcggggactcgcctccgcgggtgctcaaggctgaaggcgccggaccttcccccacggtggcacgcacatcatccggcaccatttccgtgccccgaagacgcccgcgcgggacctgggaccgccagtgaagaacccctcctgggctctttaacgagcagcagatgcgcatgctgcttctctccggcaggaaagccttctaagcccggcgtgctcgggcacccgagggtggaaccgcggcccctgcacacactcaccccaaagtctcaacgtcgaaccgaaggcgacacccacccaactcctccctctccgccccatagtccacccaacacttgcagcccctccagagaaaaagcccagcggaagaggactccggaaaagtgactatctcggaagaccagggtagagctcccgggagaaaaaggcgaagatccccggccccggatcgccatccccttccctggcaccagcttctctaggctgcgcgaaggaagagggtacgacgccggggagggactgggtgcgcgggcatgaagttggaggtgttcgtccctcgcgcggcccacggggacaagcagggcagtgacctggagggcgcgggcggcagcgacgcgccgtccccgctgtcggcggcgggagacgactccctgggctcagatggggactgcgcggccaacagcccggccgcgggcggcggcgccagagatacgcagggcgacggcgaacagagtgcgggaggcgggccgggcgcggaggaggcgatcccggcagcagctgctgcagcggtggtggcggagggcgcggaggccggggcggcggggccaggcgcgggcggcgcggggagcggcgagggtgcacgcagcaagccatatacgcggcggcccaagcccccctactcgtacatcgcgctcatcgccatggccatccgcgactcggcgggcgggcgcttgacgctggcggagatcaacgagtacctcatgggcaagttcccctttttccgcggcagctacacgggctggcgcaactccgtgcgccacaacctttcgctcaacgactgcttcgtcaaggtgctgcgcgacccctcgcggccctggggcaaggacaactactggatgctcaaccccaacagcgagtacaccttcgccgacggggtcttccgccgccgccgcaagcgcctcagccaccgcgcgccggtccccgcgcccgggctgcggcccgaggaggccccgggcctccccgccgccccgccgcccgcgcccgccgccccggcctcgccccgcatgcgctcgcccgcccgccaggaggagcgcgccagccccgcgggcaagttctccagctccttcgccatcgacagcatcctgcgcaagcccttccgcagccgccgcctcagggacacggcccccgggacgacgcttcagtggggcgccgcgccctgcccgccgctgcccgcgttccccgcgctcctccccgcggcgccctgcagggccctgctgccgctctgcgcgtacggcgcgggcgagccggcgcggctgggcgcgcgcgaggccgaggtgccaccgaccgcgccgcccctcctgcttgcacctctcccggcggcggcccccgccaagccactccgaggcccggcggccggcggcgcgcacctgtactgccccctgcggctgcccgcagccctgcaggcggcctcagtccgccgccctggcccgcacctgccgtacccggtggagacgctcctagcctgagtagcgccgcggggcccgggaacgccgagtgcgcgccgtcggggaggcgggaacgcgggcccgcgcgcggactttgcactttgaatccagaggaagatgaatttttaaaatctccatcaaacgtgccttaaagctaaagcattttgacaggagtatttaaacttagtccaggatattttcctttgtgttttataactttacagaggaccaaagcaattcttgttttagtttctttgcgaagcctgctcctccttcccttcataaggactttttttgtctttctttaacgcccaggcttcgtcttatttctactgtttttgtcgcaacttccattgatttatgtcccttccctcccccctaagtacatcagggaacctttccacactataaatgatatgactactgtttggggtttctgggcccccatccgtgtacgtatgtggcatttccaggtatgactgagtgtgagagacatgtcagaggctcttcagtgatttcttgctattgaccgatgcttcactgtgccaaaagagaaaaaaaatgttgggttttgtaattaaattatttatatatttttgaaacccgaattgaaaatgttgcaggcaacgggctacagctttattagtggttctctaactgtggtctccttgggccaagcaatttctttaaaggaaaagttgattatgtatgtggggtgccaggaccactgccttgaaagcaagtgtgatttttatttttaatattattttatttgtgtctgtgtacatattcatgtataaattttatgaaacccaagcatagtgcttattttttaataaaacaactgacttaacacattgtga

SEQ ID NO: 76 - DNA, 3016 bp, Homo sapiens
aatccgcattcagttgtcgaggagtgccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaagaaggaatctcaaaagaatgataaagatttgaagatattagagaaagagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcatttaaccaa

SEQ ID NO: 77 - DNA, 777 bp, Homo sapiens
gcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtcctttttta

SEQ ID NO: 78 - DNA, 3715 bp, Homo sapiens
ctttgagcggaagttggatcactgaagcgccaaaaaagaatttaggggaagacctgattttcgcttgaggcatttttgcggcgctgtgcgctacagacaccttctggaagctgcggtggggaaactgagtttcccgagccgttgagacagatggggttcagcaccgcgcggggacgacaggaaagctgcggctgaagagaactgcggacttggcaggagtcgcctgaggagctaagatcccggagactcttagccccgtggtgcttctctacgggagggagggagggagaatccggccggacagatctgcgcgtatcctggagccggcccagttgtgaactaggagagctttgggacctctgtcccaagcaagagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctgaacaaaccccacagtttttgctttcaacaaagaccccacagtcaatgcagtcaacattggatcgattcataccatataaaggctggaagctttatttctctgaagtttacagcgatagctctcctttgattgagaagattcaagcatttgaaaaatttttcacaaggcatattgatttgtatgacaaggatgaaatagaaagaaagggaagtattttggtagattttaaagaactgacagaaggtggtgaagtaactaacttgataccagatatagcaactgaactaagagatgcacctgagaaaaccttggcttgcatgggtttggcaatacatcaggtgttaactaaggaccttgaaaggcatgcagctgagttacaagcccaggaaggattgtctaatgatggagaaacaatggtaaatgtgccacatattcatgcaagggtgtacaactatgagcctttgacacagctcaagaatgtcagagcaaattactatggaaaatacattgctctaagagggacagtggttcgtgtcagtaatataaagcctctttgcaccaagatggcttttctttgtgctgcatgtggagaaattcagagctttcctcttccagatggaaaatacagtcttcccacaaagtgtcctgtgcctgtgtgtcgaggcaggtcatttactgctctccgcagctctcctctcacagttacgatggactggcagtcaatcaaaatccaggaattgatgtctgatgatcagagagaagcaggtcggattccacgaacaatagaatgtgagcttgttcatgatcttgtggatagctgtgtcccgggagacacagtgactattactggaattgtcaaagtctcaaatgcggaagaaggttctcgaaataagaatgacaagtgtatgttccttttgtatattgaagcaaattctattagtaatagcaaaggacagaaaacaaagagttctgaggatgggtgtaagcatggaatgttgatggagttctcacttaaagacctttatgccatccaagagattcaagctgaagaaaacctgtttaaactcattgtcaactcgctttgccctgtcatttttggtcatgaacttgttaaagcaggtttggcattagcactctttggaggaagccagaaatacgcagatgacaaaaacagaattccaattcggggagacccccacatccttgttgttggagatccaggcctaggaaaaagtcaaatgctacaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtatttgtggaatcgatgaatttgataagatggggaatcaacatcaagccttgttggaagccatggagcagcaaagtattagtcttgctaaggctggtgtggtttgtagccttcctgcaagaacttccattattgctgctgcaaatccagttggaggacattacaataaagccaaaacagtttctgagaatttaaaaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaaccaaagaagacgctgaggatatagtggaaattatgaaatatagcatgctaggaacttactctgatgaatttgggaacctagattttgagcgatcccagcatggttctggaatgagcaacaggtcaacagcgaaaagatttatttctgctctcaacaacgttgctgaaagaacttataataatatatttcaatttcatcaacttcggcagattgccaaagaactaaacattcaggttgctgattttgaaaattttattggatcactaaatgaccagggttacctcttgaaaaaaggcccaaaagtttaccagcttcaaactatgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaatttaaacttagctgggtatggtggcacatgcctatagtctcagctacttgtgaggctgaggcaggaggattctttgagcccaggagtttgaggttacagtgagccacaatcacaccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgccttttatatgtatgaatatttcatagttttgcatatcagatgtaggcatacagacaaatacataaaccaatgaatatattacatattctgtgttccaataaaactttatttatggacactaaaatttgaatttcataaaattttcccatgtcaagaatacaaaatacttgagttttgttttta

SEQ ID NO: 79 - DNA, 5297 bp, Homo sapiens
caacaaactaagcagttgctcaatcgttgattgatcctcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaaaaaaaaaaaaaaaaaaaa

SEQ ID NO: 80 - DNA, 4812 bp, Homo sapiens
tgatccggcggcgcgggattggccagtcccgggccaacacgggtggcgggagttttcagatgtgttggctgcggccccgacttcagcggttgggctaggctgtgctgactgtttgggtggcggaccccgggagtaaaacctgttgtcgatccctcagcttccagcttgcggcttgctgagtggccaccttctttccggtccccggagctgcggggaaagatggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttcatttaaatattaggacactgacggatgatatgctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaaaaatgatggaagatatgaatttaaatgaagataaaaaggcaccattgcgggaaaaggacttcagtatcaaaaaagaaatggtgatgcagtacattaatactgcttctaagacaggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccagatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactgagggtgatgagacaggagtgatggataatctgctggaggccttgcagtccggggctgccttccgcgacagaagaaaaaggacaccgatgccaaaagatgttcggcagagtctcagtccaatgtctcagaggcctgttctgaaagtttgtaaccatgaaaatcagaaagtgcagttgacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgattgcaatgctttttctatgtactggaggttttggtttattcaagattgtaccgggctttaatccttttttttttttttttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatgtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatgaaaaaaaaaaaaaaaaaa

SEQ ID NO: 81 - DNA, 1217 bp, Homo sapiens
acatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcggagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctattttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataaccaaa

SEQ ID NO: 82 - DNA, 2646 bp, Homo sapiens
gacttctgcagtttctgtttccttgactggcagctcagcggggccctcccgcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgatggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaacaaaaaaaaaaaaaaaaaaaa

SEQ ID NO: 83 - DNA, 8630 bp, Homo sapiens
taaatttaaaggcggggcggcctgtgagccctgaagtgccggccgcggagggtcctggccattttcctgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattctccagaattccttgggaggaaatgcaaagacacgtattatctgcacaattactccagtatcttttgatgaaacacttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagatgcaactaattcatgaaatttcgaacttaaagaatttagttaagcatgcagaagtatataatcaagatcttgagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagctgaaggagaaaatgaaagaacttgcaactacatacaagcaaatggaaaatgatattcagttatatcaaagccagttggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctacgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaagaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaagatccaagaacttcagaaaaaagaacttcaactgcttagagtgaaagaagatgtcaatatgagtcataaaaaaattaatgaaatggaacagttgaagaagcaatttgaggcccaaaacttatctatgcaaagtgtgagaatggataacttccagttgactaagaaacttcatgaaagccttgaagaaataagaattgtagctaaagaaagagatgagctaaggaggataaaagaatctctcaaaatggaaagggaccaattcatagcaaccttaagggaaatgatagctagagaccgacagaaccaccaagtaaaacctgaaaaaaggttactaagtgatggacaacagcaccttacggaaagcctgagagaaaagtgctctagaataaaagagcttttgaagagatactcagagatggatgatcattatgagtgcttgaatagattgtctcttgacttggagaaggaaattgaattccaaaaagagctttcaatgagagttaaagcaaacctctcacttccctatttacaaaccaaacacattgaaaaactttttactgcaaaccagagatgctccatggaattccacagaatcatgaagaaactgaagtatgtgttaagctatgttacaaaaataaaagaagaacaacatgaatccatcaataaatttgaaatggattttattgatgaagtggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgtaaagttatctacatgacttagcatattccaaagcataatacatacattaatataaaacatcattttattaacaaaattgtaaatgtttttaataccttacacattcaataaatgtttagtagttctgaatcaccaaaaaaaaaaaaaaaaaa

SEQ ID NO: 84 - DNA, 3614 bp, Homo sapiens
gcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaactcaaggaacatctgttgagaagaaaaacgctttttgcatacaagcaggaaaatgagatgttatccagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacttctgccaatgttacaatccggaaagggcctcatgaaaaagaactattacaatcaaaaacagctttatctagtgtcaaaaccagttcttctcaaggtataataagaaataagactctatcaagatccatagcatctgaagttatagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcagcctattgaagagatgcgacacacgattgtagatattctaacaatgaagagtcaagaaaaagctaatttaggagaaaatatggagaagtcttgtgcaagcaaggaagaagtcaaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaagtgtgaaaaaaaaggtgcagtttgatggaacaaattccgcatttaaagagctgaagtttttaacaccagtgagacgttctcgacgtcttcaagagaaaacttctaaattgccagatatgttaaaagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatggggtttttattatttgtggggtgttttgttttgagtagctttatattgctcttaggtctggagttggccatgtacctatgtatcctaagcattcacggcagtgagctcctttactaacattcatgttatggcaagagttgtcctctacattggaaagctaatcctaccttgtcagtttcaaccaactgagttttttctttaagaaaggtaaattttgtcagctagtttactatgttccttgaatataaacaggttataatactaccctgttcactttactaaatataagtacagtaatgatgcataattagaaaatgaggtattctaggtaaaatgtatgtttgccttgacatgtttttaaaagttatgatgtacctccctgcctttaaacagaatacttttttcttttttttggcctttctcagattagtcaaaaattctatagaatgactcacttcgaatactaagacacaggaggtttagcctgctttcttaccaaattcatgttacccagacttgtgttctcttgcgtcccttggactgcctgttgattgatggaaagtgtctgcactgacacttttcgtcagtagtctgtagtttcgtggcctcttttgattataactggggtcaccaagaaggtttacttaattaaataccgcatttctaagagaagatactttgtgtaagaaaagatgccacatttagtggtttaacttttgtaacttcacttgatagtttttaagcaattagaatggagttagggaaagaacatatcatactgaacaaatgtcattctagtttagatagcatttctaagataactgatactaatacttgttttcttccctataacataaaaaacttcactgttaagtcatgtcccttgaaacatgatagttacatacacagttttctctccacacataaataacaccactaaagttgttttgtaaggttccaaactaatatggcatatatcaactctacagtttcaaataaatgactttttaattgtaaaagattagttgaaaaactgtatgaatgtgaagatcacatgcttagtcatttttatgttcattccactttgtatatcttttctatttattgacttctcatgttctagagagtaggacttttattccgtgtacctgatatatatacaattaaaatatctgtgtaattatgttttaatgaagtttatttcaacagatattttatgaaatgcagtttaaccacagtgaatgaattttagctttgcttttgaaatacattgtaagatttgacttgaggtttttgacacttaagtacatgcttaatgatatattttcaaaagtcatcagtctacttacataaactttacctaatttttttcactttaacaaaaacataactatgcccttgttttttcatactttgacccaaaatatgccattttgaaataaaatttaagctttgataca

SEQ ID NO: 85 - DNA, 2058 bp, Homo sapiens
gcacataacgggcagaacgcactgcgaagcggcttcttcagagcacgggctggaactggcaggcaccgcgagcccctagcacccgacaagctgagtgtgcaggacgagtccccaccacacccacaccacagccgctgaatgaggcttccaggcgtccgctcgcggcccgcagagccccgccgtgggtccgcccgctgaggcgcccccagccagtgcgctcacctgccagactgcgcgccatggggcaacccgggaacggcagcgccttcttgctggcacccaatagaagccatgcgccggaccacgacgtcacgcagcaaagggacgaggtgtgggtggtgggcatgggcatcgtcatgtctctcatcgtcctggccatcgtgtttggcaatgtgctggtcatcacagccattgccaagttcgagcgtctgcagacggtcaccaactacttcatcacttcactggcctgtgctgatctggtcatgggcctggcagtggtgccctttggggccgcccatattcttatgaaaatgtggacttttggcaacttctggtgcgagttttggacttccattgatgtgctgtgcgtcacggccagcattgagaccctgtgcgtgatcgcagtggatcgctactttgccattacttcacctttcaagtaccagagcctgctgaccaagaataaggcccgggtgatcattctgatggtgtggattgtgtcaggccttacctccttcttgcccattcagatgcactggtaccgggccacccaccaggaagccatcaactgctatgccaatgagacctgctgtgacttcttcacgaaccaagcctatgccattgcctcttccatcgtgtccttctacgttcccctggtgatcatggtcttcgtctactccagggtctttcaggaggccaaaaggcagctccagaagattgacaaatctgagggccgcttccatgtccagaaccttagccaggtggagcaggatgggcggacggggcatggactccgcagatcttccaagttctgcttgaaggagcacaaagccctcaagacgttaggcatcatcatgggcactttcaccctctgctggctgcccttcttcatcgttaacattgtgcatgtgatccaggataacctcatccgtaaggaagtttacatcctcctaaattggataggctatgtcaattctggtttcaatccccttatctactgccggagcccagatttcaggattgccttccaggagcttctgtgcctgcgcaggtcttctttgaaggcctatgggaatggctactccagcaacggcaacacaggggagcagagtggatatcacgtggaacaggagaaagaaaataaactgctgtgtgaagacctcccaggcacggaagactttgtgggccatcaaggtactgtgcctagcgataacattgattcacaagggaggaattgtagtacaaatgactcactgctgtaaagcagtttttctacttttaaagacccccccccccaacagaacactaaacagactatttaacttgagggtaataaacttagaataaaattgtaaaattgtatagagatatgcagaaggaagggcatccttctgccttttttatttttttaagctgtaaaaagagagaaaacttatttgagtgattatttgttatttgtacagttcagttcctctttgcatggaatttgtaagtttatgtctaaagagctttagtcctagaggacctgagtctgctatattttcatgacttttccatgtatctacctcactattcaagtattaggggtaatatattgctgctggtaatttgtatctgaaggagattttccttcctacacccttggacttgaggattttgagtatctcggacctttcagctgtgaacatggactcttcccccactcctcttatttgctcacacggggtattttaggcagggatttgaggagcagcttcagttgttttcccgagcaaagtctaaagtttacagtaaataaattgtttgaccatgccttcattgcaaaaaaaaaaaaaaaaa

SEQ ID NO: 86 - DNA, 7291 bp, Homo sapiens
attcaaattgcggccttctggggagccggcgctggaggtggtgagtggcgtggggactgtgtcgagggggtccccaaggtgccggaccctgcggaggggcgaagtttcggcactggggagggcgtgcggacgctttccctacaggcgaccactgctctgcgggcgggtggtcttagctccagtcccccattcagttcctcagcattccaggtcggcggcgaaggggtccccgaacgaagggcgcaaggcagcgtctctgctgggaccgggaagccggacttcagggcctctcggcccgtgggcttctccccgagtctccccgagtcggttggcattaagagtttagcagatactttcagaaatggatacataagaaatggctggaaatcaaatgaatgtccaaagaagagcttagggtcttagtaacattcttttttaaaataactgtctgccaaaatgtcattacacagtactcataatagaaataacagcggtgatattcttgatattccttcttcccaaaatagttcatcactgaatgccctcacccacagtagccgacttaagctgcatttgaagtcggatatgtcagaatgtgaaaatgatgatccattattgagatctgcaggtaaagtcagagacataaatagaacttatgttatttctgccagtagaaaaacagcagacatgccccttacccctaatcctgtaggtagattggcacttcagaggagaactacaaggaacaaagaatcatctttgcttgttagtgagttggaagacacaactgaaaaaacagcagaaacacgtcttacattacaacgtcgtgctaaaacagattctgcagaaaagtggaaaacagctgaaatagattctgtcaaaatgacactgaatgtgggaggtgaaacagaaaataatggtgtttctaaggaaagtagaacaaatgtaaggattgtaaataatgctaaaaactcttttgttgcctcttctgtacctttagatgaagatccacaggtcattgaaatgatggctgataagaaatacaaagaaacattttctgcccccagtagagcaaatgaaaatgttgcacttaagtactcaagtaatagaccacccattgcttccctgagtcagactgaagttgttagatcaggacacttgacaacgaaacctactcagagcaagttggatatcaaagtgttgggaacaggaaacttgtatcatagaagtattgggaaggaaattgcaaaaacttcaaataaatttgggagcttagaaaaaagaacacctacaaaatgtacaacagaacacaaactgacaacaaagtgcagcctgcctcagcttaagagcccagctccatcaatactgaagaatagaatgtctaaccttcaagttaaacaaagaccaaaaagttcctttcttgcaaataaacaggaaagatccgcagaaaatacaattcttcccgaagaagaaactgtagttcagaacacctctgcaggaaaagaccccttaaaagtagagaatagtcaagtgacagtggcagtacgcgtaagacctttcaccaagagagagaagattgaaaaagcatcccaggtagtcttcatgagtgggaaagaaataactgtggaacaccctgacacgaaacaagtttataattttatttatgatgtttcattctggtcttttgatgaatgtcatcctcactacgctagccagacaactgtctatgagaagctagcagcaccactcctagaaagagccttcgaaggcttcaatacctgtctttttgcttatggtcagactggctctggaaaatcatatacgatgatgggatttagtgaagaaccaggaataattccaagattttgtgaagatcttttttctcaagtagccagaaaacaaacccaagaggtcagctatcacattgaaatgagcttctttgaagtatataatgaaaaaattcacgaccttctggtttgtaaagatgaaaatgggcagagaaagcaaccactgagagtgagggaacatcctgtttatggaccatatgttgaagcactgtcaatgaacattgtcagttcttacgctgatatccagagttggctagaattgggaaataaacaaagagctactgctgctactggtatgaatgataaaagttcccgatctcattcagttttcaccctggtgatgacccagaccaagacagaatttgtggaaggggaagaacacgatcacagaataacaagtcgaattaacctaatagatctggcaggcagtgagcgctgctctacggctcacactaatggagatcgactaaaggaaggtgtgagtattaataagtccttgctaactttgggaaaagttatatctgcactttcggaacaagcaaaccaaaggagtgtttttattccttatcgtgaatctgttcttacatggctgttaaaagaaagtctgggtggaaattcaaaaactgcaatgattgctacgattagtcccgctgccagcaacatagaagaaacattaagcacacttagatatgctaaccaagcccgtttaatagtcaacattgctaaagtaaatgaagatatgaacgctaagttaattagagaattgaaggcagaaattgcaaagctaaaagctgctcagagaaacagtcggaatattgaccctgaacgatacaggctctgtcggcaagaaataacatccttaagaatgaaactgcatcaacaggagagagacatggcagaaatgcaaagagtgtggaaagaaaagtttgaacaagctgaaaaaagaaaacttcaagaaacaaaagagttacagaaagcaggaattatgtttcaaatggacaatcatttaccaaaccttgttaatctgaatgaagatccacaactatctgagatgctgctatatatgataaaagaaggaacaactacagttggaaagtataaaccaaactcaagccatgatattcagttatctggggtgctgattgctgatgatcattgtactatcaaaaattttggtgggacagtgagtattatcccagttggggaagcaaagacatatgtaaatggaaaacatattttggaaatcacagtattacgtcatggtgatcgagtgattcttggtggagatcattattttagatttaatcatccagtagaagtccagaaaggaaaaaggccatctggaagagatactcctataagtgagggtccaaaagactttgaatttgcaaaaaatgagttgctcatggcacagagatcacaacttgaagcagaaataaaagaggctcagttgaaggcaaaggaagaaatgatgcaaggaatccagattgcaaaagaaatggctcagcaagagctttcttctcaaaaagctgcatatgaaagcaaaataaaagcactggaagcagaactgagagaagagtctcaaaggaaaaaaatgcaggaaataaataaccagaaggctaatcacaaaattgaggaattagaaaaggcaaagcagcatcttgaacaggaaatatatgtcaacaaaaagcgattagaaatggaaacattggctacaaaacaggctttagaagaccatagcatccgccatgcaagaattctggaagctttagaaactgaaaagcaaaaaattgctaaagaagtacaaattctacagcagaatcggaataatagggataaaacttttacagtgcagacaacttggagctctatgaaactctcaatgatgattcaggaagccaatgctatcagcagcaaattgaaaacatactatgtttttggcagacatgatatatcagataaaagtagttctgacacttctattcgggttcgtaacctgaaactaggaatctcaacattctggagtctggaaaagtttgaatctaaacttgcagcaatgaaagaactttatgagagtaatggtagtaacaggggtgaagatgccttttgtgatcctgaagatgaatgggaacccgacattacagatgcaccagtttcttcactttctagaaggaggagtaggagtttgatgaagaacagaagaatttctggttgtttacatgacatacaagtccatccaattaagaatttgcattcttcacattcatcaggtttaatggacaaatcaagcactatttactcaaattcagcagagtcctttcttcctggaatttgcaaagaattgattggttcttcgttagatttttttggacagagttatgatgaagaaagaactatagcagacagcctaattaatagttttcttaaaatttataatgggctatttgccatttccaaggctcatgaagaacaagatgaagaaagtcaagataacttgttttcttctgatcgagcaatccagtcacttactattcagactgcatgtgcttttgagcagctagtagtgctaatgaaacactggctgagtgatttactgccttgtaccaacatagcaagacttgaggatgagttgagacaagaagttaaaaaactgggaggctacttacagttatttttgcagggatgctgtttggatatttcatcaatgataaaagaggctcaaaagaatgcaatccaaattgtacaacaagctgtaaagtatgtggggcagttagcagttctgaaagggagcaagctacattttctagaaaacggtaacaataaagctgccagtgtccaggaggaattcatggatgctgtttgtgatggtgtaggcttaggaatgaagattttattagattctggactggaaaaagcaaaagaacttcagcatgaactctttaggcagtgtacaaaaaatgaggttaccaaagaaatgaaaactaatgccatgggattgattagatctcttgaaaacatctttgctgaatcgaaaattaaaagtttcagaaggcaagtacaagaagaaaactttgaataccaagatttcaagaggatggttaatcgtgctccagaattcttaaagttaaaacattgcttagagaaagctattgaaattattatttctgcactgaaaggatgccatagtgatataaatcttctccagacttgtgttgaaagtattcgcaacttggccagtgatttttacagtgacttcagtgtgccttctacttctgttggcagctatgagagtagagtaactcacattgtccaccaggaactagaatctctagctaagtctctcctcttttgttttgaatctgaagaaagccctgatttgttgaaaccctgggaaacttataatcaaaataccaaagaagaacaccaacaatctaaatcaagcgggattgacggcagtaagaataaaggtgtaccaaagcgtgtctatgagctccatggctcatccccagcagtgagctcagaggaatgcacacccagtaggattcagtgggtgtgaatactgatgtgtaggcacttttatgaccacccatgaaagaaaaagaacacttgctcggtaattttctttatgcaggagagtttaagagaaatcagcacagatatttcaaaaaagtccatgtctttttatctttaaaatatctatttatcaaaggccagacacagtggctcacgcctgtaatcccagcactttgggaggcgggcagatcacaaggtcaggagtttgagaccggcctggccaacatggcgaaaccccgtctctactaaaaatacaaaaatttgctgggcatggtggcgcgtgcctgtaatcccagctactaggggggctgaggcaggaggatcgcttgaacctgagaggcagaggttgcagtgagccaagatcatgccactttactccagtctgagcaacagaacgagacttagtcaaaataaataaataaataaataaataaataaataaataaataaataaaatatatttttatctttaaagtgtttaacattggtatactgtctgtagttggttcattagtcgtttataaagggttattttctcatgagtggaaacctgaacaatcagttacctttgtgcctatgccttctctctcctcagacagctgggatgtttatggtgaaatggcctgtacaagtttaactaagacaacttaacttgcattgttaatcaaaaattcttttctcaaagggttaactggttgccattttgaatagtatgttcaagggtgtagcttcctgtttctttccaaattataagtagctacctaaatatagtataattatatattaataatatggcttgctggcacagtagtttaccctgttatctgtgtttcataatgggggctgtatgaatattatttaaaactaataaaatgttgccagaattatactaaactgttggatgagattaggagatcagaggctggaccttctcttgataatgcttgttttgttaaaggtataatgaaataatttgtatatgatttgatgaagattaaagacccttattttccacagctttaaaaaaaaacctttatttatgatcaagtaataaagataatattctacttgtgggatcttacattacggaaatagtttgacgtttttgacctcaagagtatgtataatttgaagagatactttgtaactatgcttgggtgatattgagcagttcctaaagaataattcatttaaaaaaaaagaagaaaaaaaaagaagaattcatttaaataacctgatcctttcatttgcccttttcgaatttacagatactacttgtacatttggcataactagttgaaattggccattcgtaccatgaataaatctgatagtttccttgttaggaagagattgtaagtaaatacagtcattgcagtcagaacagtattagtgaaccttgtgtggtgttttcaagctctttaaaatggtacaatgtagcacatttgctttcatttctttttttatttttggcatttgaccttgtattctttctgaagctctatatgtgtttttattagtcaataatctggcaagtagcactttgcctgtgcagtttgctggagtgtagatgtacatatgaggatttcccgggaggtgcacttctttgaagaacttcctaaagtacctgtatagtagttttcatcttaatattcagtatttaatcttcagtttgtgctttgtaaactcatgacttaattggtcagaaactttttagtgtctttataaaattttgtatacatatttatactaaacacattgtgatactgtatttgaatgaatggtgaaaaaatatttgctattggaattatgtgcactgacaagaaatgttataaagagaatgcctttaataaatcttttcagcattagaa

SEQ ID NO: 87 - DNA, 2484 bp, Homo sapiens
gttgactaggcctcgggggcgacgttcattgaccaggcggctgagtttcgcggggtctgcgggtttagggcgccgacgctctgcaaacggcagcggaggccttaacgcgtcgcggccgggagaatcggagcgagccaggcttgagggcgaatgtcccgggaggacttgtggcggccctggtttcgcctcctcctttctcgttgcatcttccccggcgtgggggcaggggctgggggtggcagttgggagcaccgtctctgacacctaggccccgggggtggctctgccaccaagtcgtaggcgagcgtaatgaaagcaaagatagcaaattgtaaggagggctttgacttttgtcatcttctgaatgacgcacagctgatgtcatcctaattaagcgcattcactcctagtctctggaaatgcaaatcaaatatgcgagatgcggcactgcatttttaatgttgaccataatgtaatgatgaagcaaatttttatttaattttcgagtctgcacctattttggccaagtaaagacagtaaaatagggagagcctcctgaggatctgaatttattgccctggcacataatttttagctctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtattagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgaaaaaaaaaaa

SEQ ID NO: 88 - DNA, 10290 bp, Homo sapiens
agaagcgggcgaattgggcaccggtggcggctgcgggcagtttgaattagactctgggctccagcccgccgaagccgcgccagaactgtactctccgagaggtcgttttcccgtccccgagagcaagtttatttacaaatgttggagtaataaagaaggcagaacaaaatgagctgggctttggaagaatggaaagaagggctgcctacaagagctcttcagaaaattcaagagcttgaaggacagcttgacaaactgaagaaggaaaagcagcaaaggcagtttcagcttgacagtctcgaggctgcgctgcagaagcaaaaacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaacaagaggtgactccaagtcgatcaactttgcaaatagggaaaagagatgctaatagcagtttctttgacaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctctaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaaaatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaagatggacaatctaaaatatgtaaatcagttgaagaaggaaaatgaacgtgcccaggggaaaatgaagttgttgatcaaatcctgtaaacagctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtagaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaacggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatatcacaatctctgtttgtatgtgggttttacactaaaaaaatgcaaaacacattttattcttctaattaacagctcctaggaaaatgtagacttttgctttatgatattctatctgtagtatgaggcatggaatagttttgtatcgggaatttctcagagctgagtaaaatgaaggaaaagcatgttatgtgtttttaaggaaaatgtgcacacatatacatgtaggagtgtttatctttctcttacaatctgttttagacatctttgcttatgaaacctgtacatatgtgtgtgtgggtatgtgtttatttccagtgagggctgcaggcttcctagaggtgtgctataccatgcgtctgtcgttgtgcttttttctgtttttagaccaattttttacagttctttggtaagcattgtcgtatctggtgatggattaacatatagcctttgttttctaataaaatagtcgccttcgttttctgtaa

SEQ ID NO: 89 - DNA, 2410 bp, Homo sapiens
gaggcaggaaaagcggaagagggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcgagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggacgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaactaatttccttcccaatattaggacttagaaaagctctaggtcccgcaatttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtgaagttgtgcttttcctctacttctacttcctctccccgacctttttctgcccagtgtaggtgtattcttaaattcagacaggggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaaaaaaaaaaaa

SEQ ID NO: 90 - DNA, 3783 bp, Homo sapiens
gcatactgctagtggcgcgcggaggagcgacgcgtggagaagcggcccacgtgtctgcccagagtcaagtcctgtgttcttcccgctccttacgcatccgcggtccagggcgccctttcagccccgctggtgttcgcccaccccgggccgcgtgagtggggccccacgcagctccccgcactccgtgggccaacttggccaagcaactctgtccggggagcggtgcttgcggggggtgagtaccgggcactgcgcatgcggagctccaaattcaaacagctgttttcagaggctggagggcgggcggactggtagcagctggggctaggagaggctttctctaggaggcggccgctcgggagccatggtggaccggggccctctgctcacctcggccatcatcttctacctggccatcggggcggcgatcttcgaagtgctggaggagccacactggaaggaggccaagaaaaactactacacacagaagctgcatctgctcaaggagttcccgtgcctgggtcaggagggcctggacaagatcctagaggtggtatctgatgctgcaggacagggtgtggccatcacagggaaccagaccttcaacaactggaactggcccaatgcaatgatttttgcagcgaccgtcattaccaccattggatatggcaatgtggctcccaagacccccgccggtcgcctcttctgtgttttctatggtctcttcggggtgccgctctgcctgacgtggatcagtgccctgggcaagttcttcgggggacgtgccaagagactagggcagttccttaccaagagaggtgtgagtctgcggaaggcgcagatcacgtgcacagtcatcttcatcgtgtggggcgtcctagtccacctggtgatcccacccttcgtattcatggtgactgaggggtggaactacatcgagggcctctactactccttcatcaccatctccaccatcggcttcggtgactttgtggccggtgtgaaccccagcgccaactaccacgccctgtaccgctacttcgtggagctctggatctacttggggctggcctggctgtccctttttgtcaactggaaggtgagcatgtttgtggaagtccacaaagccattaagaagcggcggcggcgacggaaggagtcctttgagagctccccacactcccggaaggccctgcaggtgaaggggagcacagcctccaaggacgtcaacatcttcagctttctttccaagaaggaagagacctacaacgacctcatcaagcagatcgggaagaaggccatgaagacaagcgggggtggggagacgggcccgggcccagggctggggcctcaaggcggtgggctcccagcactgcccccttccctggtgcccctggtagtctactccaagaaccgggtgcccaccttggaagaggtgtcacagacactgaggagcaaaggccacgtatcaaggtccccagatgaggaggctgtggcacgggcccctgaagacagctcccctgcccccgaggtgttcatgaaccagctggaccgcatcagcgaggaatgcgagccatgggacgcccaggactaccacccactcatcttccaggacgccagcatcaccttcgtgaacacggaggctggcctctcagacgaggagacctccaagtcctcgctagaggacaacttggcaggggaggagagcccccagcagggggctgaagccaaggcgcccctgaacatgggcgagttcccctcctcctccgagtccaccttcaccagcactgagtctgagctctctgtgccttacgaacagctgatgaatgagtacaacaaggctaacagccccaagggcacatgaggcagggccggctccccaccccacctttgatggcctcttcccccctcaccctagggtgtcccgagatgaccgggacgcctggcccctggtgggggggcagcctcggaactgggagtggggggccaggggccttcctaaccttccatcatcctcagctagatgtatgcccgggacagggcctctgttctccagctgaaccataccctggctgtgggggcatctgtcctgagcttggctggtgtatctcacaatgcaaagacatgctggctggcgggacaggtgggcaggactgaccctgaggaggccttgcctgcagggtctttgtctcaccatttggtggagtatcacacggttctctgaggtctggggcctcagctgtttaagtttaccggtattactgagctcggcatttggagagggagctctgaagtgtctggggaggtaccgctgtgcgtggggtcaggtgtttccgtaccacagcaggagcagggcccgcccgcatcccagctgtgggcctgccggtcaggtcgggcacctactacaaaccgtagtggggtggaggctgctggaggtgggagtgaggagatgagggcagggtctcaaacagtcctgactcacagggcctggaaacaagtcctatgtgggcctggggcctggggtcctcatcctccttgttggtctactcaggcccagcccagagctgtgttccctgtctcaggtcaagcagtggcagacgcaaggctttctgtgggcccccaagtggtaggagggagagtagcagagcatgggttactggaagccgggactgctagggctggtggccagggagctgcaagagtgaggctcagctctggctggttctgcccttacccctcctgcccgcctgagaactgcacaccctgcccgctggccccaggacctgcactcccaatcctgctgtcttctccttccctgtgccctgaacaaggacctcactgcccgccttcccctcccaccagcccccttgggccaggcagggtgaggccaaattgctcttggcccacaaatgggtgatggtcagatatgtgaatcaagctcctttctctagctagtgtttgatgtgcacgtgtgtgtgcacagtgcgtgtgtgcacacgcacacctgtgcactcgtgtgtgtttaagaaaggaaaggatttgggctggggagcaaaagataatgtgaaactgttggtggactctctggtgaggggtgggcagaacttgctgctactagagttcttgggttctccatgatgttcaccctggggctggcccactgtgtcctgaatgtttttgttattttttgttttattttttaaacaaactgctgtttttatatacctggaatctgttgttggcttcagagccagtggttaaagagcagggtcccaaggattgggagatctagtgtctgccctcctgccctgcaactcaattgggcctttttcggtgacctcatccaaggccatgatgtcaagggccatgtccccaagcagaggtggagaaggggacactgaggtgagcaaaagcaggaaggggcatccactgcgggtgactggaggccgggcaggaagcaagtcatcagagccgctcagctccgttcactctctgccttctgccccactactgtggggcagtggggccagagcccacctccccaacatgtgaagacagtgatgggcacgtgcccacacccccacttctctagccgtttgcagaggccgccacccagcaggggcctgaaaaggagcagcctcgtatttttctgtgaaatgttttaatgaaccatgttgttgctggttgtcctggcatcgcgcacactgtatgtacatactggcaacgatgtcaaatgtaatttattttaacatttttacaataaaacatgaggtggacaggcca

SEQ ID NO: 91 - DNA, 1808 bp, Homo sapiens
gcacgtagagcagctaggtgggcttcggggttgcagctgctgcggctccgcagctgctccggctccgggacccttagagtccattcgcgtgccttctattgaagagcaggaactgacggttgttttaggcctctcaattccagaaagtttcctggggacctgtccggtcggaaagtcgagggacagttgtcttggtatttgtaaagggggtatccagtgaggcggagcttgagggggttgtgtcgagtgactgatacagctgtcaaccaataaagctactatcgctcgcctcaggaaaaccatcacaactccagctggatgtgcgcataatagtgtaatcactcatgattctattttgtttaataattcgttcttgagactagacgtctcgaaagcgaagactggcactcctcagcctgccacggacggctcgcaggccgatactgaacagaagtacccttatcaaggaggcgtcacccctgggcaagcctagcatcagtccattgacacctacagtcaccatgatagacgttctcccagaccaacagcttcctttggctcgaggcgggtcttacgtggagggcctatgggaactacgtcggctcagccaatagggtcagggcagggggcgtggcgggaagtttgaaactggtaacttcgggagttgagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggttctatgcgcaatagatggaaaccaaacagcagcaaggtactagggagatcccccctcaccatcctgcaggatgacaactcccctggcaccctgacactacgacagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtatatgtaaaccttgcaccgag

SEQ ID NO: 92 - DNA, 3091 bp, Homo sapiens
atcacagcccttccccgatcctctccgtgggagccagcgagcctctctccctgatcttacgtgctcaagggagctcacacgttcaccaactcacccttgaagtcatctcaagaacaaaagacaactgaaagaagctgttgtgaaggcagagcagcatctgctgaagagacagaaaccagccccagaggtgtcacaggaaggcaccagcaaggacattggtctttgatttgattcagcagtcctgtcaagtataaatgtgatggctgtgctgcctggccctctgcagctgctgggagtgctgcttaccatttccctgagttccatcaggctcattcaggctggtgcctactatgggatcaagccgctgccacctcaaattcctcctcagatgccaccacaaattccacaataccagcccctgggtcagcaagtacctcacatgcctttggccaaagatggccttgccatgggcaaggagatgccccacttgcagtatggcaaagagtatccacacctaccccaatatatgaaggaaattcaaccggcgccaagaatgggcaaggaagccgtacccaagaaaggcaaagaaataccattagccagtttacgaggggaacaaggtccccgtggagagcctggcccaagaggaccacctgggccccctggtttgccaggtcatgggatacctggaattaaaggaaaaccagggccacagggatatccaggagttggaaagccaggtatgcctggaatgccagggaagccaggagccatgggcatgcctggggcaaaaggagaaattggacagaaaggggaaattgggcctatggggatcccaggaccacaaggacctccagggcctcatggacttcctggcattgggaagccaggtgggccagggttaccagggcaaccaggaccaaagggtgatcgaggacccaaaggactaccaggacctcaaggccttcggggtcctaaaggagacaagggcttcgggatgccaggtgcgccaggtgtaaaggggcctccagggatgcacggccctcccggccctgttggactgccaggagtgggcaaaccaggagtgacaggcttccctgggccccagggccccctgggaaagccaggggctccaggagaacctgggccacaaggccctattggggtaccgggggttcaaggacctcctgggatacccggaattggaaagccaggccaggatgggatcccaggccagccaggatttccaggtggcaaaggggagcaaggactgccagggctaccaggacccccaggccttccagggattgggaaaccaggcttcccaggacccaaaggtgaccggggcatgggaggtgttcctggggctcttggaccaagaggggagaaaggaccaataggtgccccaggaatagggggtcctccaggagagccaggcctgcctggaatcccaggtcctatgggccctccaggtgctattggttttcctggacccaaaggagaaggtgggattgtagggccacaggggccaccaggtcccaagggtgagccagggcttcaaggcttcccaggaaagccaggtttccttggtgaagtagggcctcctggcatgaggggtttgccaggtcccatagggcccaagggggaagctgggcaaaaaggtgtaccaggactccctggtgttccagggcttctcggacctaagggagagccaggaatcccaggggatcagggtttacagggccccccaggtatcccagggattgggggccctagtggccccattggaccacctgggattccaggccccaaaggggagccgggcctcccagggccccctgggttccctggtatagggaaacccggagtggcaggacttcatggccccccagggaagcctggtgcccttggtcctcaaggccagcctggccttccaggacccccaggccctccaggacctccaggacccccagctgtgatgccccctacaccaccaccccagggagagtatctgccagatatggggctgggaattgatggcgtgaaacccccccatgcctacggggctaagaaaggcaagaatggagggccagcctatgagatgcctgcatttaccgccgagctaaccgcacctttcccaccggtgggggccccagtgaagtttaacaaactgctgtataacggcagacagaactacaacccgcagacaggcatcttcacctgtgaggtccctggtgtctactactttgcataccacgttcactgcaaggggggcaacgtgtgggttgctctattcaagaacaacgagcccgtgatgtacacgtacgacgagtacaaaaagggcttcctggaccaggcatctgggagtgcagtgctgctgctcaggcccggagaccgggtgttcctccagatgccctcagaacaggctgcaggactgtatgccgggcagtatgtccactcctccttttcaggatatttattgtatcccatgtaaaaacaaaaaaacaaaaaacaaagaaaagaaagagattttatagaagaaaatgacacaccaaaaaatccaaatgaaaaacataattgcttcaaaacacttacacagttggaaagttatatgtaagtgaaaatttggaccattgtgtacaaataaaaactaagatgcatgtttaatactccacacagcagcctgtaattgcgaatgatgggatagagttatgtatcaagtactgacacttggttgtacccactggaatcatattagctgttttatgttatatgcttccacagtaacctgcttattcagatcagtcaaaatatatcagtatgaaagatcatagctaatgaaaggcactcactcatattgtttactttaaaatatttataaatatgccttaaagaaatacaaatgataacaattacataccgtatttacttgcttaatttcctctgtatttgtgtagatactttgacatggaatatatggtggggagacccgtagtgttaccgccccagtgggagggggccctggggaccctggtaatgctttagtcaaagggatatctctcttgtatcagaggctgtgtcttttagtaac

SEQ ID NO: 93 - DNA, 4963 bp, Homo sapiens
gagttactcttgcatttggcaattaaagatgatgtttccatggaaacagttgatcctgctttcattcattggctgcttaggaggtgagcttctcttacaaggccctgtatttatcaaagaacccagcaacagcattttccctgttggttcagaagataaaaaaataactttgcattgtgaagcaagaggcaatccatcacctcattacagatggcagctgaatggaagtgatattgatatgagtatggaacatcgttataagttgaatggaggaaatcttgtggttattaatcccaacagaaattgggatacaggaacttaccaatgttttgcaacaaattcacttggaacaattgtcagcagagaagccaaacttcagtttgcctatcttgaaaattttaaaaccaaaatgaggagtacagtgtctgtgcgtgaaggccagggagttgtgctgctctgcggccccccaccacactctggagaactgtcatatgcttggatcttcaatgaatacccatcgtttgttgaagaagatagtcggagatttgtctcccaggagacagggcacctctacatatctaaggtggagccgtctgatgtgggaaattacacatgtgtggtgacaagtatggtgacaaatgcccgagtgctgggctctccaactcctttggtgctacgttctgatggtgtgatgggtgaatatgaacctaaaatagaagttcagtttccagaaactcttccagcagctaaaggttcgactgtgaaattggaatgttttgcccttggaaatcccatacctcagattaattggagaagaagtgatgggctgccattttccagcaaaattaaattaaggaagttcagtggtgtgcttgaaatccccaacttccaacaggaagatgcaggttcctatgaatgcattgctgagaattcacgaggaaaaaatgttgccagagggcgtctcacttactatgcaaagccccattgggttcaactcataaaggatgtggaaatagccgtggaggacagtctttattgggaatgcagggcaagcggcaagcccaagccttcctaccgatggctgaaaaatggagcagccctggtgctagaggagagaacacagatagaaaatggtgcccttacaatatcaaacctaagtgtgactgattctggcatgttccaatgcatagcagaaaacaaacatggccttgtttattccagtgctgagctcaaagttgttgcttctgctccagatttttcaaagaatccaatgaagaagttggttcaggtgcaggtgggcagcctggtcagcttggattgtaaacccagagcctccccaagggcactctcttcctggaagaagggggatgtgagcgtgcaggagcatgaaagaatttctttgttaaacgatggaggactcaaaatagccaatgtgactaaagctgatgctggaacttacacctgcatggcagaaaaccagtttgggaaagcaaatggcacaacacatttggttgttacggaaccaacaagaataactttggcaccatctaacatggatgtttctgttggtgaaagcgtcatattgccctgccaggtacaacatgacccgctgttagacatcatctttacctggtatttcaatggggcccttgcagattttaagaaagatggatctcactttgagaaagttggtgggagttcatctggtgatttaatgatcagaaacattcagctgaaacacagtgggaaatatgtttgtatggtgcaaacgggggtggacagtgtttcatctgctgctgacctcatagtaagaggttcacctggaccaccagaaaatgtgaaggtagatgaaattacagacacaacagcccaactctcttggaaagaaggtaaagacaaccatagcccagttatatcctattctatccaggctcggacacctttctccgtgggttggcaaaccgtcacaacagtgcctgaggtcatcgatgggaagacgcacacagccactgtagttgagttaaacccatgggtggaatatgaatttcgggttgtagccagtaacaaaattggaggtggagaaccaagtttaccctcagaaaaagtaagaactgaagaggcagttccagaagtgcctccttctgaagtcaatggaggaggcggaagccggtctgaacttgtgataacctgggatccagtccctgaagaactacagaatggtgaaggttttgggtatgttgttgctttccgccctcttggggttaccacctggatccagacagtggtgacatcccctgacaccccaagatatgtctttaggaatgaaagcatcgtgccatattcaccatatgaagttaaagtgggtgtttataataacaaaggtgaaggaccatttagcccagtgacaacagtgttctctgcagaagaagagcctacagtggccccatctcaagtctctgcaaatagcctatcttcctcagaaattgaggtttcatggaacaccattccttggaagttgagcaatggacatttactgggctatgaggtgcggtactggaatgggggtggaaaggaggaatcatccagtaagatgaaagtggcaggaaatgagacatcagccagactacggggcctgaagagcaacctggcctattacacggctgtccgggcttacaacagtgccggcgctgggccttttagcgccacagttaatgtaaccaccaagaaaacgcctcccagtcagccaccaggaaatgttgtttggaatgccacagacactaaagtgttacttaattgggagcaagttaaagccatggagaatgagtcagaagtaacaggatataaagttttctataggactagcagtcaaaataacgtacaagtactgaacacaaataaaacttcagctgaacttgtgctgcccattaaagaggactacattattgaagtcaaggccacaacagatggaggggatgggaccagtagtgaacagatcaggattccacgaataaccagtatggatgcaagaggatccacttcagccatctcgaatgtccaccctatgtcaagttatatgcctatagtactgttcttaattgtatatgtcctgtggtgatattaactcctttttattatttattggaaagttatttggttaccaaaaaaagtgctttcatgaaatgcagtgattatgcatgtttttttcaactcttatttttaactttctacttcattataggtaaatatgaatataattaaaaaaacagtaaatccttttaggggaatctgaaatgccttaatattaacttgataaaccaaaggaatttacatattacatacttcagacttttgatataaatgttcttaaactatgagtttaagcactgcctatggataaagactcacacactctcacatgtacacacacacgcatgagaatttctttttacattgaaaaactctttcatttaattcaaatgctattttcccattataatagcattatttggaagacttaaccagtatcaatttgaaatgctgatttaagtccccaaggatgaaaaatacattttaaaaattattttgttggagaggagtggcatgtgattcaaaagagcattgttggaaaatgctactgtggggcttagaagaatgatgtttggtttggtatgctgctaactagttgtaagactttacaaatcactttgccatctgtacctctcaattattcctctataaaatatggagataataatacctatctgatcagactttgccccatgaattagtttttaaaagataaagactgaagtatgaaagtgcttttgtcaccccaaatgcaattgacccatgcaaaatattagcatgaatttatttaatcacataaaagtcatgaagaccagccagattttcaagcttcattctgtttcattcagttatattccaaaattcaaatgatcacattttattctttctcaaaaaaaaaaagtttttttaaattaaaaaaggaattgtttccttcacagctatgaataagctttcaggttttattaaaacctagaggaaaaaatcaggaatgacctgaatctcaacccaaatattaaacaaaatccacataatccctcatttcaatttccaattccattaagggaccctctctttttggatggcagagatggttttttaatgaaatcccaccatctatctgagtgagtctggcaggctttttagttcctgagttaaatttgtaatagaaccaaggcaatgctgctgactttgatatgtatgactcagtctttcaatatgtggttttcaaaaaattgttgaagacgtgacttcatagcaatatatagagaataaattaaaatcagcagattgagttttcaacattgcaaaatcagttttttacctctttcctaccaatttcacattttgcagaaacttgttcacatttccaacaatatcagaattagaaaacagttcagataacaagaaagattaaaaattagggaaattctgatatcaccataaagcactattttacatttagagattacatttaagataaagtcatcatacacaaaaacaataaatatttataactttctctataaggtccgcatatactgtatatattgaaacaatctgaatgactagtagatttcatatgaccattgttatttccactttctccaatacttgtattttatgctacatgtaatgaagttggacctttttattatttagtaattcctatatgttcctatacttttcattttcaagatgattgctctattgtttcatgttgtttctagcaatatatctccatgagatatgcactttgtttcatattgaaaagtataaaatttatctttcaattcctgtgtgtgtatcctatggttatctgtatgtattattttctattctaataaaatttataacaagcaaaaaaaaaaaaaaaaaa

SEQ ID NO: 94 - DNA, 5082 bp, Homo sapiens
ggggctccgacagaggcggcgattgtggcggcccatttgtaaatgctgcggagattgaggtgtcggttcgtgctgctgagctgcccaggcttcacggagcggtgttggaaatcaatagctcttctagcctttgcattgtttaaatataatagtgtcattggactaagatgttcctgatgccaacctcttcagagttaaacagtgggcagaacttcctaacccagtggatgaccaatccttctcgggctggggtcatattaaatcgtggatttcctattttggaagcagacaaagagaagcgagcagctgtggacatttctaccagctttcctattaaaggcacacatttttctgatagcttcagctttataaatgaagaagattcacttcttgaagaacagaagttggagtcaaacaacccttacaaaccacagtcagataaatctgaaacccatacagcctttccttgcattaaaaagggaccacaggtagcggcatgtcacagtgctcctggacaccaggaagaaaacaaaaatgacttcatcccagatcttgcgagtgaattcaaagaaggggcttataaagacccactttttaaaaaacttgaacagctgaaagaagtacaacagaagaagcaggaacaattgaagaggcaacagttggagcaactacagagactcatggaagaacaagagaagctgctcaccatggtgtctgggcagtgcacacttccaggtttgagtttactgcctgatgatcagagccagaagcacaggtctccaggaaataccaccactggagagagagccacatgctgcttcccatcatatgtctacccggacccaacccaggaagaaacatacccgtccaacattttatcccatgagcaaagcaacttctgtagaactgctcatggagattttgtcttaacttcaaaacgtgcgtctcctaatttattttctgaggcacagtatcaagaagcacctgtggaaaaaaataatttaaaagaagaaaaccgtaaccatcctacaggagaaagtatcttatgttgggagaaagtgacagaacagattcaggaagcaaatgataagaacttacaaaaacatgatgattcctcagaagtggctaatattgaagaaaggcccattaaagctgctattggagaaaggaaacagacctttgaagattacttagaagaacaaattcagttggaagagcaagaactgaagcaaaaacagctgaaggaagcagaaggaccattgccaatcaaagcaaaaccaaaacaaccatttttaaaacgaggagaaggtttagctagatttactaatgccaaatctaagtttcaaaaaggcaaagaaagtaaactagtgactaaccagagcacttccgaggaccagccgctgtttaaaatggatagacagcaactccagcggaaaaccgctcttaaaaataaagagctgtgtgcagacaaccctatccttaaaaaggacagtaaagctagaaccaagagtggttctgtcaccctcagtcagaagccgaaaatgctgaagtgtagtaacaggaaaagtctttctccgtcaggattgaaaatacagacggggaagaaatgtgatgggcagtttagagaccagatcaaatttgaaaacaaagtcacatctaataataaagaaaatgtaactgagtgtccaaaaccttgcgatactggctgcacagggtggaataagacacaaggtaaagacagacttcctctttcaacagggccggccagccggctggctgctaagagccccataagggagaccatgaaagagtctgaatcttctcttgacgtttctcttcagaaaaagttagagacttgggaacgagaaaaggaaaaggaaaatttggaattagatgaatttttgtttttagaacaagctgctgatgaaatatcattttctagtaattcctcatttgtactgaaaatcttagaaagggatcaacagatctgcaaaggtcaccggatgtcttccacccctgtcaaagctgtgccacagaagacaaatccggcagatcccattagtcattgtaaccgcagtgaggatttggaccacactgcacgtgagaaggagagtgagtgtgaagtcgcacccaaacaacttcattcattgtcctcagctgatgaattgagggaacagccttgtaaaatcaggaaagccgtccaaaagagcacttctgaaaatcagactgaatggaatgcacgtgacgatgaaggtgttccaaatagtgacagtagcactgactctgaggaacagcttgatgttaccataaaaccatcgactgaggatagagagaggggcatcagcagcagagaggatagcccacaagtctgtgatgataaggggccttttaaggacaccaggacccaagaagataaaaggagagatgttgatctggatttgtctgataaagattacagtagcgatgagtctatcatggaaagcataaaacataaagtgtctgagccctcgagatcctcatccctaagtctgagtaaaatggactttgatgatgaaagaacttggactgaccttgaagagaatttgtgtaaccatgatgttgttcttgggaatgaatccacttatgggacgccgcagacatgctaccctaataatgaaataggtatcctggacaaaacaataaaaaggaagattgcaccagtcaagaggggagaagacttgagcaagtccaggaggagcagaagtcctcctacatcggagctgatgatgaaattctttccttctttgaaaccaaaaccaaagtcagattcacacttgggaaatgaactcaagttaaacataagtcaagaccaaccacctggtgacaatgctcgatcccaggttttgagagagaaaattattgaattggaaacagaaatagaaaagtttaaagctgagaacgcatctttagctaaacttcgcattgaacgagaaagtgccttggaaaaactcaggaaagaaattgcagacttcgaacaacagaaagcaaaagaattagctcgaatagaagagtttaaaaaggaggagatgaggaagctacaaaaggaacgtaaagtttttgaaaagtatactacagctgcaagaacttttccagataaaaaggaacgtgaagaaatacagactttaaaacagcaaatagcagatttacgggaagatttgaaaagaaaggaaaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcgaacacatctgttcgatttcaaaacagtcagatttcttcaggaacccaggtagaaaaatacaagaaaaattatcttccaatgcaaggcaatccacctcgaagatccaagtctgcacctcctcgtgatttaggcaatttggataagggacaagctgcctctcccagggagccacttgaaccactgaacttcccagatcctgaatataaagaggaggaggaagaccaagacatacagggagaaatcagtcatcctgatggaaaggtggaaaaggtttataagaatgggtgccgtgttatactgtttcccaatggaactcgaaaggaagtgagtgcagatgggaagaccatcactgtcactttctttaatggtgacgtgaagcaggtcatgccagaccaaagagtgatctactactatgcagctgcccagaccactcacacgacatacccggagggactggaagtcttacatttctcaagtggacaaatagaaaaacattacccagatggaagaaaagaaatcacgtttcctgaccagactgttaaaaacttatttcctgatggacaagaagaaagcattttcccagatggtacaattgtcagagtacaacgtgatggcaacaaactcatagagtttaataatggccaaagagaactacatactgcccagttcaagagacgggaatacccagatggcactgttaaaaccgtatatgcaaacggtcatcaagaaacgaagtacagatccggtcggataagagttaaggacaaggagggtaatgtgctaatggacacggagctgtgacgatcctcatgtgatcatgaagtaacagtaactgactttttatgttaaaaaatgtacatttactgtggattctgtttaatttattgtgtatgtgtggggaaaagattagattctaaaataaaagtttaccctgtggcatcttcatttttatattctttgaaatgcaatgatagctctcatttataattcactaccctgtctttcaatagactaaggaaagcattttgactgtttagaaattgtgtacaggtttttacagtaagtgggtgtgtttattggttagaaatggctataaaaaaaaaccaagaagtacaggaagtacatcacctagatgtcccacagacacatcagccgtagagcactggacttgtacagaaggtgtactcaaggagtaaacacgtgtctctgtagccaaaatattactatgttcagttagtaccaaaattagaccatttgatcttctacagaggatcattaattattataacagaatgggaagttacaacagtggatgaatataaataggtcacacacaacaggtagtaatcatggtgaagagaaagcagttataacaaggctgactttgtaatgtaatgtctcaaaatgggatacttgagagtggaggggggcatgaacgatgactagccagtgttaacccatggaccacagctaccctgatgttaccacagtgagattactgtagcctcatggaagcaagatgtccctgaaggatgggcaagtcacttacttacttacttgtaaatttatataataaataattacagattggtctagatagaccttacctgtcacatatactatgaatcaggttttgttaatgaaatctatcaattccaggtgacttaactgaatatgaaaaataaaactttttgaagaa

SEQ ID NO: 95 - DNA, 2560 bp, Homo sapiens
agtcggtctcgccgcgctcgccgggtgtcccagtgtcaccaacactcggccgccgccgccagcttggcgcgcaccgccgcctccgccaccgccgacagcgcgcatcctccgtgtccccgctccgccgcccgagcaggtgccactatgcacgtgaagaagtacctgctgaagggcctgcatcggctgcagaagggccccggctacacgtacaaggagctgctggtgtggtactgcgacaacaccaacacccacggccccaagcgcatcatctgtgaggggcccaagaagaaagccatgtggttcctgctcaccctgctcttcgccgccctcgtctgctggcagtggggcatcttcatcaggacctacttgagctgggaggtcagcgtctccctctccgtaggcttcaagaccatggacttccctgccgtcaccatctgcaatgctagccccttcaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggacaagcttcagcgcatgggggagccctacagcccgtgcaccgtgaatggttctgaggtccccgtccaaaacttctacagtgactacaacacgacctactccatccaggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaaccctgcccctgcccaccccgggcggctgaaactcactgagcagccaagactgttgcccgaggcctcactgtatggtgccctctccaaagggtcgggagggtagctctccaggccagagcttgtgtccttcaacagagaggccagcggcaactggtccgttactggccaagggctctgtagaatcacggtgctggtacaggatgcaggaataaattgtatcttcacctggttcctaccctcgtccctacctgtcctgatcctggtcctgaagacccctcggaacaccctctcctggtggcaggccacttccctcccagtgccagtctccatccaccccagagaggaacaggcgggtgggccatgtggttttctccttcctggccttggctggcctctggggcaggggtggtggagagatggaagggcatcaggtgtagggaccctgccaagtggcacctgatttactctagaaaataaaagtagaaaatactga

SEQ ID NO: 96 - DNA, 2799 bp, Homo sapiens
caagggctagaagcgcgacggcggtagcagctaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacggagccgaggaggaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaacttttttaaaaactagattgctttgaaaacatgactcaataaaagtttcctttcaatttaaa

SEQ ID NO: 97 - DNA, 2504 bp, Homo sapiens
gattcaaactgctgctcctccggctggcggggatcagcgctggcgcggctgcggccgctgctgcctacgcgccatggagcatcgcatcgtggggcccgggccgtaccgagctaccaggctgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagataaagattgccttagtttttaaaaatgtttggccattagtatttttataaaactcaatgctagttttaaagtgtataaattggttaaaatttatgagtcaaatatatagtgataatgttaacatgtttgtaattgctacagaatttaagggtatttttatctctgtgctttctttttcatggtgtttattaaataattgtgtatatacatcctagctactgatatctttattatagccttaagacttaattttaagtcttaaaaatagcgtgtatacttgaataagaaagacactgggtactgttactgtgatgctattgacttagtagccaattatcatttctcctgtataaattccagtttttattgctgcacataaattttttaatgtcttatattgtgatagctatgtcttttattgcagatttattggatgttatgacagattttactaaagctagtgtttttataacatatatattagttgatgtttacctataagtggagtagattttcatctgcctgcaatggtataatttcagtcttagctaaaaatggaaagttgaactggataaattctttgggtacccttagacctctgattctaagtcaaatgcaaatgggttaaataaaatgagactacttcctttataaatatattttcatccttttgaaagtaagtgaaatgtaaataaacttattttttttaaaaatgcca

SEQ ID NO: 98 - DNA, 4076 bp, Homo sapiens
gcgagagcggcgcctgatgacgaccgggagggcggggcccgtctggggcgccggcgggtgcgtttgaatctggtccgagcgcgggaaacggcgggtccccgagcccagggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaaggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaacatccatttgtttatttgaaagtattaggggcccggcgcagtggcacacgcctgtaatcccagcactttgggaggctgaggcaggcagatagatcacttgaggtcaggagttcaagaccagcctagacaacatggtgaaaccccgt

SEQ ID NO: 99 - DNA, 2782 bp, Homo sapiens
agtgggcggaccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagtttgccttccaagccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagaacctgctgcatgtcacagacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacccttgtcttaaaagaagaagcatctgattaccttgaattggatacaattaaaaatctcgtcaaaaaatattcacagttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaaactgtctgggactgggaacttatgaatgatatcaaaccaatatggcagagaccatcaaaagaagtagaagaagatgaatacaaagctttctacaaatcattttcaaaggaaagtgatgaccccatggcttatattcactttactgctgaaggggaagttaccttcaaatcaattttatttgtacccacatctgctccacgtggtctgtttgacgaatatggatctaaaaagagcgattacattaagctctatgtgcgccgtgtattcatcacagacgacttccatgatatgatgcctaaatacctcaattttgtcaagggtgtggtggactcagatgatctccccttgaatgtttcccgcgagactcttcagcaacataaactgcttaaggtgattaggaagaagcttgttcgtaaaacgctggacatgatcaagaagattgctgatgataaatacaatgatactttttggaaagaatttggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtggaagaagagcccgaagaagaacctgaagagacagcagaagacacaacagaagacacagagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactgactattcttgatgtaaaatcttgtcatgtgtataaaaataaaaaagatcccaaata

SEQ ID NO: 100 - DNA, 2488 bp, Homo sapiens
acacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgcca

SEQ ID NO: 101 - DNA, 3620 bp, Homo sapiens
gcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtatatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaataca

SEQ ID NO: 102 - DNA, 5177 bp, Homo sapiens
gccgtccgcggaaatttgaaatggctgacgggtcgctgacgggcggcggtctggaggcagcggccatggcgccggagcgcatgggctgggcggtggagcaggagctggcgtctctggagaaaggtttgttccaagatgaagattcatgcagtgattgtagctaccgtgataaaccaggttctagtttacaaagttttatgccagaaggaaaaacctttttcccagaaattttccaaacaaatcaacttttgttctatgagcgattcagagcctatcaagattacattttagctgactgcaaggcctctgaggtacaggaattcacagctgagttcttggagaaggtccttgagccatctggatggcgggcagtctggcacactaatgtgttcaaggtgctggttgagatcacagatgtggactttgcagccttgaaggcagtggtgaggcttgctgaaccatacctctgtgactctcaagtgagcacttttaccatggagtgcatgaaggagctccttgatctgaaggagcatcggttgcccctgcaggagctgtgggtggtgtttgatgattcaggagtgtttgaccagacagcccttgcaattgagcatgtcagatttttctaccaaaacatttggaggagttgggatgaagaagaggaggatgaatacgattattttgtcagatgtgttgaacctcgattaagattgcattatgacattcttgaagaccgagttccatcaggacttattgttgactaccacaatctgttgtctcaatgtgaggagagttacaggaaatttttaaatctgagaagcagtttgtcaaattgtaactctgattccgagcaggaaaatatctccatggtggaagggttaaaattgtattcggagatggaacagttgaaacaaaagctgaaactcattgagaatcctttgttgaggtatgtgtttggttatcagaagaattctaacatccaagcaaagggtgtccgttccagcggtcagaagatcactcatgtggtctcctccaccatgatggctggtctcctgcggtccctgcttacggacaggctttgccaggagcctggtgaggaagaaagagaaattcagttccatagtgatccattgtctgctataaatgcctgcttcgaaggtgacactgttattgtttgtcctggccattatgtggtacatggcactttctccattgctgactccattgagttggaaggatatggcctaccagatgacattgtgatagaaaagaggggcaaaggcgacacttttgtggactgcactggtgctgatattaaaatctcaggcataaaatttgttcagcatgatgctgtagagggaatcttaattgttcaccgtggtaagactacgctggaaaactgtgtgctgcagtgtgagacgaccggagtcacagtgcggacatcagcagagtttctaatgaagaactcggatttatatggcgccaagggtgctggtatagaaatctaccctgggagtcagtgcaccctgagtgacaatgggatccatcactgcaaggaagggatcctcattaaggacttcttagatgaacattatgacattcccaagatatccatggtgaataatataatacataataatgaaggttatggtgttgtcttggtgaaacctacaatcttctctgacctgcaagaaaatgctgaagatggaactgaagaaaataaagcgcttaaaattcagacaagtggagagccagatgtggctgaaagagtggatctagaagagctgattgagtgtgcaactggtaaaatggagctttgtgcaagaactgacccttctgagcaagtcgagggaaattgtgaaattgtaaatgaactaattgctgcctccacacagaaaggccagataaagaagaaaaggttgagtgaactggggatcacgcaagctgatgacaacttaatgtcacaggagatgtttgttgggattgtggggaaccagttcaagtggaatgggaaaggtagttttggcacatttcttttctgactacagtgatgtaagtagatagcaaaatactggattttgcacatgctgccctaagaatcactgctgccattgtagtttgctgtattgtctgtattttatatttgattatttgggcttgagtgaaaggtagatttatttccatttgcaggtgttgcacataaaacactccctctttataagaaaaatcataaatgcatataaaatagaaaatatttggagattgcttatctgaaagtcttgctttcttatacacatggttctctcatattaagcctggtagtaactttttagtgtaattacctttagcacttcaaagacgaggaagtaaggaagggaatgcaagactagtgcataaaaatgcaataggtgtcatatgtacagcattcttcttagagttgccttttcatcccaattacagtgagtctgatttccatcctgtatttgcataatacttgtcttaaaataaaagcttttatgattgggaatttatctgcctaatcagacttattattgagacgtcaatgggacgcatttttctgttgagctatgcagtcgtcaaaacagcgatagacagcataggaggtttgaagcagaaatgaaatgtgttattcagagccaatgttgtacatagagcattttcactattgctgaatgggaatgattaaaaacaaggtatttttcgggccaggcggtggctcacgcttgtaatcgcagcactttgggaggctgaggcaggaggatcacttgagcccaggagttcaagactagcctaggcaacatagtgagaccctgtctctactaaaaataaatttaaaaaaaattagctgagtgtggtggtgcatgcatgtagttccagctactcaggaggctgaggctagaggatccttgagcccaggaggttgaggctgcagtgaggtgtgattgcgccactgcattccagcttgggcgacagagcgagacccagtctcaaaaaaaaaaaaaagtatttttctcttaccgttacagtattctgattatattactgacacagtcaaaatgattaactgtacaacctgtatctgctgggtgttcttgttatcatattgtaaaacagctttaaaaatatttatattttaaaaactgtatgtgacattaatatgcctaatgattaaaattatagtgatgaaataacaaaattgaatcttgttatatcttttcaaactcactgtgggccatagtgtcagtgtagcatatgtggtcatttaagaatacatggtattttggtatctgttttcatgctttagaaagagtattacattttttcccattaagtgtggttatgtttgttttttaaatttgagtaaaaaataattcttattttttggatgctactaaatgtaggatttatgttagatttattatttgatcattgaaaggtatttttacttttaaaaaatcttgttgcaaggaggtttaaaaagtaatgttcatttctgcatcagtttcagccaaatgttgatattaaaaccttttattcttttttttaatttttgcctctagatgtgatgccttaagataaaaaccatttattcaacttaaaaaaaaatcactttttttttttttttgagatggagtcttgctctgtcacccaggctggagtgcagtggcactatctcggcttactgtaacctccacctcctgaattcaagcaattctcctgcctcagtcgcctgagtagctgggattataggtgcccgccaccatgcccagctaattttttttttgtatttattttatttttattttattttgttttgtttttgagatggagcttcactttgtcacccaggctggagtgcagtggcatgatctcggctcattgcaacctcagtctcctgggttcaagtgattctcatgcctcagcctcccaagtagctggtatgacagccaccatgcctggctaatttttgtatttttagtagagacagggtttaaccatgttggccaggctggtctcaaactcctgacctcaagtgatccacccaccttggcctcccaaagtgctgggattacaggcatgagccacgtgcctggccttttttttgtatttttagtagatatggggtttcaccatgttgcccaggctgttctcaaactcctgacctcaagtgatccacccacctcagcctcccaaatcacattgatttttcaattgaatttctactttatcttggtttagattttgtagataagttagtaacatttataccttccttgtttctttttataacatggagtttttcagatttcatgtctattttagcttaaatctaagcttatattaatttttattcacatgattcattataatgagtaggcctactttgttcttatttaagttatatgcagtacattttgcctcaatcatggagagttaaacatctcaaatggtatagcatagggaatttagggagtgccctagaggggtatgggtttgatatttgagatgaaaacactgatgtggagaaaggatagccttctgtgttgactaattgtgtgtcctgtccttatggtccactcttagtgtgaccttgaatttatggcaggtagcaaaattctattttgctgatttgagtattttattttagcttctttagatgtatttcccttcttcagtttcttgttgtattattgcaccatagatattaacacgaatatatttttaaaaactgcccagagatcatttgatctcaagtgtatatacacttcacttttctggagttacagaaggatggtgaaataatcattttctggattttgcttttcagagggagattgaagaaagttcaatagaacactgatgagctcataagaaccgtgtcgttcatgtttctttgtaattcagtttgctgtttttattcttattcctttctaggaagtacattccacaggcttctatggaaattaagttgaaataaattttgataattggcctttgatgcaaaatttatgcatagcatttaattttataacattttgttttattctgtgattaaatatatatatgtatatgttttaaagtcttatatgtggtgaacattctcctctttttttagttctcactattaatagaaaaaaatatatattttaaaaacaaaa

SEQ ID NO: 103 - DNA, 6399 bp, Homo sapiens
atccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctctttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcagcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacatctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataacccagatgtgtgctctgtgtacttcttgtaataccttaaagcaaacacactaacttacacagctttgttaatcagctcccagttcagcctgactttgtgggaacttatttccctaataaattatttagaaactttaacagtgaccatccctgttgttggtaaaagataaacatgtcttggttcaaaagttaatacctcaggatggaatcaagaagcagtagacttaccagtttgattaattaagggagcactggactgggtgcgtaaggattcttaattagcattttttctcatgtttacatccaaggttatgaagtgttgtggaaagcaaagtttaacaatcatatataataaaagataatgtttatactcaca

SEQ ID NO: 104 - DNA, 2656 bp, Homo sapiens
cacacctgatggtgtgactcggccgacgcgagcgccgcgcttcgcttcagctgctagctggcccaagggaggcgaccgcggagggtggcgaggggcggccaggacccgcagccccggggccgggccggtccggaccgccagggagggcaggtcagtgggcagatcgcgtccgcgggattcaatctctgcccgctctgataacagtccttttccctggcgctcacttcgtgcctggcacccggctgggcgcctcaagaccgttgtctcttcgatcgcttctttggacttggcgaccatttcagagatgtcttccagaagtaccaaagatttaattaaaagtaagtggggatcgaagcctagtaactccaaatccgaaactacattagaaaaattaaagggagaaattgcacacttaaagacatcagtggatgaaatcacaagtgggaaaggaaagctgactgataaagagagacacagacttttggagaaaattcgagtccttgaggctgagaaggagaagaatgcttatcaactcacagagaaggacaaagaaatacagcgactgagagaccaactgaaggccagatatagtactaccgcattgcttgaacagctggaagagacaacgagagaaggagaaaggagggagcaggtgttgaaagccttatctgaagagaaagacgtattgaaacaacagttgtctgctgcaacctcacgaattgctgaacttgaaagcaaaaccaatacactccgtttatcacagactgtggctccaaactgcttcaactcatcaataaataatattcatgaaatggaaatacagctgaaagatgctctggagaaaaatcagcagtggctcgtgtatgatcagcagcgggaagtctatgtaaaaggacttttagcaaagatctttgagttggaaaagaaaacggaaacagctgctcattcactcccacagcagacaaaaaagcctgaatcagaaggttatcttcaagaagagaagcagaaatgttacaacgatctcttggcaagtgcaaaaaaagatcttgaggttgaacgacaaaccataactcagctgagttttgaactgagtgaatttcgaagaaaatatgaagaaacccaaaaagaagttcacaatttaaatcagctgttgtattcacaaagaagggcagatgtgcaacatctggaagatgataggcataaaacagagaagatacaaaaactcagggaagagaatgatattgctaggggaaaacttgaagaagagaagaagagatccgaagagctcttatctcaggtccagtttctttacacatctctgctaaagcagcaagaagaacaaacaagggtagctctgttggaacaacagatgcaggcatgtactttagactttgaaaatgaaaaactcgaccgtcaacatgtgcagcatcaattgcatgtaattcttaaggagctccgaaaagcaagaaatcaaataacacagttggaatccttgaaacagcttcatgagtttgccatcacagagccattagtcactttccaaggagagactgaaaacagagaaaaagttgccgcctcaccaaaaagtcccactgctgcactcaatgaaagcctggtggaatgtcccaagtgcaatatacagtatccagccactgagcatcgcgatctgcttgtccatgtggaatactgttcaaagtagcaaaataagtatttgttttgatattaaaagattcaatactgtattttctgttagcttgtgggcattttgaattatatatttcacattttgcataaaactgcctatctacctttgacactccagcatgctagtgaatcatgtatcttttaggctgctgtgcatttctcttggcagtgatacctccctgacatggttcatcatcaggctgcaatgacagaatgtggtgagcagcgtctactgagactactaacattttgcactgtcaaaatacttggtgaggaaaagatagctcaggttattgctaatgggttaatgcaccagcaagcaaaatattttatgttttgggggttttgaaaaatcaaagataattaaccaaggatcttaactgtgttcgcattttttatccaagcacttagaaaacctacaatcctaattttgatgtccattgttaagaggtggtgatagatactattttttttttcatattgtatagcggttattagaaaagttggggattttcttgatctttattgctgcttaccattgaaacttaacccagctgtgttccccaactctgttctgcgcacgaaacagtatctgtttgaggcataatcttaagtggccacacacaatgttttctcttatgttatctggcagtaactgtaacttgaattacattagcacattctgcttagctaaaattgttaaaataaactttaataaacccatgtagccctctcatttgattgacagtattttagttatttttggcattcttaaagctgggcaatgtaatgatcagatctttgtttgtctgaacaggtatttttatacatgctttttgtaaaccaaaaacttttaaatttcttcaggttttctaacatgcttaccactgggctactgtaaatgagaaaagaataaaattatttaatgttttaaaaaaaaaaaaaaaaaaaa

SEQ ID NO: 105 - DNA, 11725 bp, Homo sapiens
ccacttggctaaggcgaaccgccccagacgcgtccgcgcgccggcagctgcaggctcaggccatctccagtcttcctgccgcgcccgcctctcctcctgggattctcctcctcctcctggacttccccgcagctgcccacgcctcggcggccgccaggtgctcctggagtgcagcgcctatcgccggggcgtgtgggggccacaccgagcaccagcttctccgacgccgggaagccgctgtcgccgccgctacctctccctgttgccgccgcctcagatctcttcatgccgctgtaagctcggaggccaaggatgcggagtaggcttcccccagcgcttgccgccctgggcgcggccctgctcctgtcttccattgaggcagaagttgacccaccttcagacttgaattttaaaattatagatgaaaatactgttcatatgtcatgggcaaaaccagttgatccaattgtgggttacagaataacggtggaccctacaacggatgggcctactaaagaatttaccctttcagctagtaccactgaaactttattgtcagaacttgtacctgaaacagagtatgtggtgacaataacttcatatgatgaagtagaagaaagtgtaccagttataggacaactaacaattcaaacaggtagttcgacaaagccagtggagaagaaacctggaaaaaccgagatacaaaaatgctctgtcagtgcctggactgatttggttttcctcgtggatggctcttggagtgtgggaagaaataatttcaagtacattttagacttcattgctgctcttgtgtctgcttttgacattggggaagagaagacaagagttggagttgttcaatacagctctgataccaggactgaatttaacttaaatcagtactaccaaagggatgaacttcttgctgcaataaaaaaaattccatataaaggtggcaacacaatgacaggggatgccattgattatttagttaaaaatactttcacggaatctgctggggcaagagttggctttcctaaagtggcaattattattacggatggaaaatcccaggatgaagtggaaattccagcaagagagcttcgtaatgttggagttgaagttttctccttgggcattaaagctgcagatgcaaaagaactcaaacaaattgcctccacaccttcactgaaccatgttttcaatgtggccaactttgatgcaattgtggatattcagaatgagatcatctcccaggtgtgctcaggtgttgatgaacaacttggtgaattggttagtggagaagaagttgttgagcctccttcaaatttgattgccatggaagtctcttcaaaatatgttaagctaaattggaatccatctcctagtccagtgactggctacaaagtcatcctcacaccaatgactgcaggaagccgacagcacgctctgagtgtggggcctcagacaaccacgctcagtgttcgcgacctctcagcagacacagaataccagatcagtgtttccgccatgaagggaatgacatccagtgaacccatttcaataatggagaagactcagccaatgaaagttcaagtggaatgctcacgtggtgtggatataaaagccgatattgtgtttttggttgatggctcctatagcattgggattgcaaactttgttaaagttagagcctttttggaagttcttgtaaaaagttttgaaatttcaccaaatagggtccagattagtcttgtgcaatacagccgggatcctcatactgagttcactttgaaaaaattcaccaaagttgaagatataattgaagcaataaacaccttcccttacagaggaggatctacaaatactggcaaagcaatgacttatgtcagagagaaaatatttgtgcctagcaagggatcaagaagcaatgtgccaaaggtcatgattcttatcacggatgggaaatcatcagatgctttcagagatcctgcgataaaactgaggaattcagatgttgaaatctttgcagttggtgtgaaggatgccgttcgctcagaattggaagctattgcctctcctcctgcagagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggtcaatgtgactgcggagtatgaggatggcttcagcattcccttagctggagaggagaccaccgaagaagtaaaaggagcacctcgaaacctaaaggtgacagatgagactacagatagtttcaaaattacttggactcaagctccagggagagttttaagatatcgaattatatatagaccagttgctggtggagagagcagagaagttaccaccccacccaatcagaggaggagaacactggagaacttgattccagacacgaaatatgaagtatctgtaattcctgaatatttctcaggacctggtactccattaactggaaatgcagccactgaagaagttagagggaatccaagagacttaagagtttctgaccctacgacgtctactatgaaattatcttggagtggggcaccaggaaaagtgaaacagtatctcgtcacatataccccagtggcagggggtgaaactcaagaggtcactgtgaggggagatacaaccaatacggtgctgcagggattgaaggaagggacacaatacgccttatctgtgacagccttgtatgcgtctggggctggagacgccctctttggtgaaggaacaacacttgaagaacgtggttctcctcaagatttagttactaaagacatcactgacacatcaattggggcttattggacatctgctccaggaatggttcgcggttacagggtctcatggaaatcactttatgatgatgttgacactggagagaaaaatctgcctgaagatgcaattcatacgatgatagaaaatctgcagccagagaccaaatacagaatttcagtatttgccacttacagcagtggagaaggagaacctttgactggagatgccacaactgaattatctcaagattccaaaaccctgaaagtagatgaagaaacagaaaacacaatgagagttacatggaaaccagcaccagggaaagtcgtcaactaccgtgttgtctatcgccctcatgggagagggaagcaaatggttgctaaggtgccccccacagtcacttcgacagtgttaaagcgacttcagccacagaccacatatgacatcacagttcttcctatttacaagatgggagaaggaaagcttaggcaaggatcaggaacaacagcttctcggtttaagtctcctagaaacctcaaaacatctgacccaaccatgtcaagcttccgagtgacttgggagcctgcccctggggaagtgaagggttataaagtcacattccaccctacgggggatgacagaagactgggggagttagtggttggaccctatgacaacacagttgttttggaggaacttagggctggtaccacctataaagtaaatgtttttggaatgtttgatggaggagaaagctcaccacttgttggacaagaaatgacaaccctttccgacacaactgttatgccaattttatcttctgggatggagtgtctcaccagagctgaggcagacattgtgttgctggtggatggatcatggagcatcggccgggcaaattttagaaccgtgaggagtttcatttctcgtattgtggaagtctttgacattggccccaaaagagtacaaattgctcttgctcagtatagtggggatcccagaacagagtggcagttaaatgcacacagagacaagaagagcttgttgcaagctgtggcaaacttgccgtacaaaggaggcaatactctcacaggcatggctttgaatttcattcgccaacagaacttcaggacccaagctggcatgagacctcgagctcgaaaaattggtgtgctcattactgatggaaaatcacaagacgatgttgaagcaccttcaaagaaactcaaggatgagggagtggagctgtttgctattggtattaaaaatgctgatgaagtcgaattaaagatgattgcaactgatcctgatgatacccatgcatacaatgtggcagattttgagtcactctccaggatagtggatgatctcaccattaatttgtgtaacagtgtcaaaggtccaggtgatttggaagcaccttctaacttagttatttctgagcgaacccatcgttcttttagagtgagctggacaccaccttctgacagtgtggatcgatataaggtggaatactatccagtttctggagggaaacgtcaagaattttatgtgagtcgaatggaaactagcacagtgctgaaagatctgaaacctgaaactgaatatgttgtcaatgtgtattctgtggtagaagatgaatatagtgagcctctgaaggggacagaaaaaaccttgccagtgcctgtagtcagcctgaatatttatgatgttggccctaccaccatgcatgtgcagtggcagcctgtgggaggagctactggctacatcttgtcatacaaacctgttaaggacacagagccaacaagacccaaagaggtgcgtttggggccaacagtgaatgacatgcagctgactgaccttgttcccaacacggagtatgcagtcacagtccaggctgtcctgcacgacctcactagtgaacctgtcactgttcgggaagtcaccttgcctttacccagacctcaggatctgaaactcagagatgtgactcacagcactatgaatgtcttttgggaacctgtgcctggaaaagtgcgtaaatatattgttcgatacaaaacaccagaagaggatgtcaaagaggtagaggtggacagatcagagaccagcacttccctcaaagacctcttctcacagaccttgtacacagtcagcgtttctgcagtacatgacgagggggagtctcctccagtgactgctcaagaaactacccgacccgtgccagccccaacaaacttaaagattactgaagtaacatcagagggtttcagagggacttgggatcatggagcttcagatgtgtctctctacagaataacttgggcaccttttggaagctcagataagatggagaccatcttaaatggagatgaaaacactttggtgttcgaaaacctgaaccccaacaccatctatgaagtttccattactgccatctatcctgatgagtcagaaagtgatgacctgattggcagtgagcgcacactgcctatcttaacaacacaagctcccaaaagtggcccacgaaaccttcaagtgtacaatgcaacatctaacagcctgactgttaagtgggatcctgctagtggtcgtgtgcagaaatataggatcacttatcagccttccacaggggaaggcaatgagcaaacgaccacaataggaggacggcagaacagtgtggtcctgcagaaactgaagccagacactccttacactatcaccgtatcctctctgtatcctgatggtgaaggaggtcggatgacgggaagaggcaagaccaaacctctaaacactgtaaggaacctgagagtgtatgacccttctaccagcaccttgaatgtccgctgggaccatgcagagggaaatcctcgtcagtacaagctcttctatgcaccagcagcaggtggtccagaggaactggtaccaatccccgggaataccaattatgccattcttaggaatctgcagccagatacctcatacactgtgactgtagttcccgtttatactgaaggtgatgggggacgcacatcagatactggaaggacattgatgagaggactggcaagaaatgtccaagtatacaatcctacacctaacagcctcgatgttcgctgggaccctgctccaggacctgtgctgcaatatcgcgttgtgtattctcctgtggatggcacaagaccctcagaatctatagtagtgccaggaaacacgcgcatggtgcatctggagcggctgattccggacacactctattccgtgaaccttgtggctctgtactcggatggagagggaaatcccagccctgcccagggccgaacgctaccacgcagtggaccaaggaacctgagagtctttggtgaaacaaccaatagcctctcggtagcctgggatcatgctgatgggccagttcagcagtacaggatcatctattctcccactgttggtgatccaattgatgaatataccacagtcccaggcagaagaaacaatgtaatactgcagcccctgcaacctgacactccatataaaattactgttattgctgtttatgaagatggagatggtggccatctaacaggaaatggaagaactgtgggactccttcctcctcagaacatacacatctctgacgaatggtatacaagattcagggtgtcctgggatccttcaccttctccagttcttggatataaaatagtatataagccagtgggttccaatgagcccatggaagcctttgttggagaaatgacatcatataccttacacaatctcaatcccagcaccacctacgatgtgaatgtttatgctcaatatgattctggactcagtgtccccttgacagatcaaggcactacattatatttaaatgtaacagatctgaaaacttaccagattgggtgggatacattctgtgtcaaatggtcacctcaccgggcagccacctcctacaggctaaaactaagccctgcagatggaacaaggggacaagaaattacagtgcgtggatcagaaaccagtcactgcttcactggcctttcaccagacactgattatggtgtcactgtttttgtgcagacaccaaatctcgagggaccaggagtctctgttaaagaacataccactgtgaaaccaacagaagcccctacagagccacccacacctcctccccctcccaccattccaccagcccgggatgtatgcaaaggggccaaggcagatattgtgttcttgactgatgcctcctggagcattggggacgataattttaacaaagttgtaaaattcatcttcaatactgtgggaggctttgatgaaatcagtcctgctgggattcaggtttcatttgtgcaatacagcgatgaggtcaagtctgagttcaagctgaacacgtacaatgacaaggccctagcccttggggccctccagaatattaggtacagaggaggaaacacaagaacaggcaaggccctcacgtttatcaaggagaaagtcttgacttgggagagcggcatgaggaagaatgtccctaaggtgttggttgtggtcacggacggtcggtcccaggatgaggtcaagaaggcggctttggtcatccagcagtcagggttcagtgtctttgtagttggtgtggctgatgtcgactacaatgagcttgccaacattgccagcaaaccaagtgaacggcacgtgttcattgtggacgactttgaatcttttgagaagatcgaagacaatcttattacatttgtttgtgaaactgccacttcaagttgtcctctcatttatttggatggctacacctcaccaggttttaaaatgcttgaagcatacaacctgacagaaaagaattttgcttctgtacaaggagtatctttggagtcagggtctttccccagctactcagcatacaggattcagaagaatgcgtttgtgaatcagcctacagcagacctacacccaaatggactccctccttcatacacgattatattattattcagacttctcccagaaactcccagtgacccttttgcaatttggcaaatcacagacagagactacaaaccacaagttggagtgattgcagatccttctagcaagacgttatcattctttaacaaggatacaagaggcgaggtgcaaactgttacatttgacacagaagaagtaaagacattattttatggaagttttcacaaggttcatattgtagtgacctcaaaaagtgttaagatttacattgactgctatgaaattatagaaaaagacatcaaggaagctggaaatataacaactgatggttatgaaattcttggaaaactccttaaaggggaaaggaaatcagccgcattccaaatccagagttttgacattgtctgcagtccagtgtggaccagtagagacagatgctgtgatattccctctaggagagatgagggaaaatgccctgcttttccaaattcttgcacatgtacacaggacagcgttggacctccaggacctccaggccctgcaggaggacctggtgctaaaggtcccagaggtgaaagaggtatcagtggggcaattgggccccctggtcctcgtggagacataggtcctccaggcccccagggtcctccaggccctcagggacccaatggactctctattccgggagagcaaggtcgccaagggatgaaaggtgatgctggagagccaggacttccaggccgaacaggaaccccaggattacctggcccaccaggaccaatgggacctccaggagacagaggcttcactggaaaagacggtgcaatgggacccaggggcccaccagggccgccgggaagcccaggctccccaggagtcacaggaccaagtgggaagccaggaaaacctggagatcatggcagaccaggtccatctgggttgaaaggagaaaaaggtgataggggagacattgcttcccagaacatgatgcgagcagttgcaagacaagtctgtgaacaattgataagtggtcagatgaacagattcaatcagatgctgaatcagattccaaatgattaccagtccagtcgcaaccagccaggcccgccgggtccaccgggacctcctggtagcgcaggagccagaggagaacctgggcctggggggcggccaggcttcccgggcacaccagggatgcagggaccccctggggaacgaggtttgccaggagagaaaggtgaaaggggtactggatcttcaggacctcgggggctgcctggccccccaggtccacaaggagaatccagaacaggtccaccagggtccacaggttcaagaggtccccctggcccccctggccgtcctggaaactcaggtatccgaggacccccaggtcctcctggatactgtgattcttctcagtgtgccagcatcccatacaacgggcaaggctatccaggttccggctaacacattttctaagtcgccagtgctgcttacagtttgaatacatgaaaatcctgtttctgagatgtttgcgcacgtgcttattaggaaatgagtctgtatggaaatctcaccacagataatggttaacgaaccgggtcgacatcacaaaggagggtggagactctttttactaacttgaatgagacaaaagcagtggtgtcagtttataatcctgatgcatttcagtaataatgtagaaaaacattattttaaaaaagttccaacacacagccatgaggagcctcagttttgaaagaggtgcataataaaactactaaccagaggagtctatgccattttaagaaaaacaattaacctggttaaagagaaatgtcttatgtaaataataaactaattgtggcttgtaaatgatttgtatgtgatcctgtcgactaaaatcacttaacaattctacaataagcttctgcatcaaagcctgccgcttgctctatgccggaataacaccaaatggaatctcctcatctcttgcttgttagcgatgtgtctgattcagggcatctgtctttttgttacttttttgtccgtgtcctctcatttgggttttgtaactgcaattttcaaaccaaagtttaaaatcaccttttcttcctgttttgctgtagtcactggtgttcctcacccaccagctgtaactcagtttgtgtgaggtacagccacagaagatgtcatgtactgtatattacctggtgatagttgcttttcaccccccgagttcagtttctaggagccaatgaaacttcccctcacctcctcatctttccaagttgttctttgaattgaggagtttgaaggcataaacagttacttggggatttgcgaaaatcctacttagttactgcgtttacagttctttggcccagtctctgacccttcccaagtatttgtgcaatgattgtgtttactgctggatttttgaaggtttttttttttaagaaagtgccatttcattatttgattatcaccaaattatctggaaataattgggacattgtaacttatctatttatagttatgagattaagactggagtgccatcaccgcgggtgatgatttagcttttgctgtgtgtgtgtgtgtgtgccttccaaatcatgccataattgtaatgttgaatcggacagagccttacgtgcccgagggcggggcctacctgcctgagcgcgagcccttcatcgtgccggtggagcccgagcggacagcggaatacgaggactacggcgcagacgagcctgcagaggagcctcctgagccccaccggcgctggcggcgcgccctgccccacggacccgggcagtgaaccagagatcacgcgccgcgccgcgaggcttgggggaggtgttgaaattctcatttacaggtcagatagagcagtgtacgtcttttctgaggtgtttcttccagcgttgctcatccaggagtaccctttctgattgtagagaaccttgtttctgcaggaagcctagctccaagcacgcagtctgtagacatttttgcctttgcccttgaaatgcttgcaaaatactttgttaacaaaagctgcaaagagagaacatgccgtgtgcctttagttagcacagcgggcagcctcagtgaaactcttaggttaagcagttaagtcctggaacccagagctgctgtgtatttcgagcgggcagtttatcttttgctatacttattttcaattcaattacaccacgattcaaataattcccctcctaaaaccaaaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaacctccttgttttagacacactaacatttataccaaattgcagattattctgcagagagggaattgcatgtttgtgttgtatatttagtatgaacttttttcagaatataatatttcttagttatcaaaagtagttggaaaacatttgcaagactatgaacatagaattgctgcttttatattttaactgcagattgtgaatttcactgccttatattatttatttctgaaacaaaagaggcatttttcaataaaactactgaaaatttga

SEQ ID NO: 106 - DNA, 5661 bp, Homo sapiens
gctccagcggtcggcatggcagctgctacctcgctgggacaggctctgggcccacgcgtgccgcgcagtccctacagaactgcagttgtcttgtcttctcggagtgctttcggctacttttcccttattactttagctcgatacacgttgggctgcctttcacattcggatattacgctgttcgagtgctgacgggaaaggcagccctttgacacgcacgcgaaatgtcgcctgacgagggcaaaggtgacagttactaccggaagtaccctatctcagataccctttagattttcccccattgaagaaaaacgaggcgggaaaaacgctgttagggtttaactcaggccctggctccttctcgaacgaattagcggaacacccgcaggagccttgtttggcttccacttttcggcccgcccagttctctgagcgtgcggcggacgacgccggtgattggttgagcgaatggaaacggctcggcgcggtggttggccagtgggaaattctgtacgttgtgattggtccacaggaacgactcggcgcgcgcgcgggagcgagctttgaaagttgagcacggcggcggcgagccggtgccctgggatcatggtggcgttgcggggccttggtagcggcctgcagccctggtgtccgctggatcttagactcgaatgggttgacacagtgtgggaactggatttcacagagactgagcctttggatcccagcatagaagcagagatcatagagactggattggctgcattcacaaaactctatgaaagccttttaccctttgctactggagaacatggatctatggagagtatctggaccttcttcattgagaacaatgtttcccatagtacactggtggcattgttctatcattttgttcaaatagttcataagaagaatgtcagtgtacagtatcgagaatatggccttcatgccgctgggctttactttttgctactagaagtaccaggcagtgtagccaatcaagtattccacccagtgatgtttgacaaatgcattcagactctaaagaagagctggccccaggaatctaacttgaatcggaaaagaaagaaagaacagcctaagagctctcaggctaaccccgggaggcatagaaaaaggggaaagccacccaggagagaagatattgagatggatgaaattatagaagaacaagaagatgagaatatttgtttttctgcccgggacctttctcaaattcgaaatgccatctttcaccttttaaagaattttttaaggcttctgccaaagttttccttgaaagaaaagccacaatgtgtacagaattgtatagaggtctttgtttcattaactaattttgagccagttcttcatgaatgtcatgttacacaagccagagctcttaaccaagcaaaatacataccagaactggcttattatggattgtatttgctgtgctctcccattcatggagaaggagataaggtcatcagttgtgttttccatcaaatgctcagtgtaatattaatgttagaagttggtgaaggatcccatcgtgccccccttgctgttacctcccaagtcatcaactgtagaaaccaggcggtccagtttatcagcgcccttgtggatgaattaaaggagagtatattcccagtcgtccgtatcttactgcagcacatctgtgccaaggtggtagataaatcagagtatcgtacttttgcagcccagtccctagtccagctgctcagtaaacttccttgtggggaatacgctatgttcattgcctggctttacaaatactcccgaagttccaagatcccacaccgggtttttactcttgatgttgtcttagctctgttagaactgcctgaaagagaggtggataacaccctctccttggagcatcagaagttcttaaagcataagttcctggtgcaggaaattatgtttgatcgttgcttagacaaggcgcctactgtccgcagcaaggcactgtccagctttgcacactgtctggagttgactgttaccagtgcgtcggagagtatcctggagctcctgattaacagtcctacgttttctgtaatagagagtcaccctggtaccttactgagaaattcatcagctttttcctaccaaaggcagacatctaaccgttccgaaccctcaggggagatcaacatagacagcagtggtgaaacagttggatctggagaaagatgtgtcatggcaatgctgagaaggaggatcagggatgagaagaccaacgttaggaagtctgcactgcaggtattagtgagtattttgaaacactgtgatgtctcaggcatgaaggaagacctgtggattctgcaggaccagtgtcgggaccctgcagtgtctgtccggaagcaggccctccagtctcttactgaactccttatggctcagcctagatgcgtgcagatccagaaagcctggttgcggggggtggtcccggtggtgatggactgcgagagcactgtgcaggagaaggccctggagttcctggaccagctgctgctgcagaacatccggcatcacagtcattttcactctggggacgacagccaggtcctcgcctgggcgcttcttactctcctcaccaccgaaagccaggaactgagccgatatttaaataaggcttttcatatctggtccaagaaagaaaaattctcacccacttttataaacaatgtaatatctcacactggcacggaacattcggcacctgcctggatgctgctctccaagattgctggctcctcacccaggctggactacagcagaataatacaatcttgggagaaaatcagcagtcagcagaatcccaattcaaacaccttaggacatattctctgtgtgattgggcatattgcaaagcatcttcctaagagcacccgggacaaagtgactgatgctgtcaagtgtaagctgaatggatttcagtggtctctagaggtgatcagttcagctgttgacgccttgcagaggctttgtagagcatctgcagagacaccagcagaggagcaggaattgctgacgcaggtgtgtggggatgtactctccacctgcgagcaccgcctctccaacatcgttctcaaggagaatggaacagggaatatggacgaagacctgttggtgaagtacatttttaccttaggggatatagcccagctgtgtccagccagggtggagaagcgcatcttccttctgattcagtccgtcctggcttcgtctgctgatgctgaccactcaccatcatctcaaggcagcagtgaggccccagcgtctcagccacccccccaggtcagaggttctgtcatgccctctgtgattagagcacatgccatcattaccttaggtaagctgtgcttacagcacgaggatctggcaaagaagagcatcccagccctggtgcgagagctcgaggtgtgtgaggacgtggctgtccgcaacaacgtcatcattgtaatgtgcgatctctgcattcgctacaccatcatggtggacaagtatattcccaacatctccatgtgtctgaaggattccgacccattcatccggaagcagacactcatcttgcttaccaatctcttgcaggaggaatttgtgaaatggaagggctccctgttcttccgatttgtcagcactctgatcgattcacacccagacattgccagcttcggggagttttgcctggctcacctgttactgaagaggaaccctgtcatgttcttccaacacttcattgaatgtatttttcactttaataactatgagaagcatgagaagtacaacaagttcccccagtcagagagagagaagcggctgttttcattgaagggaaagtcaaacaaagagagacgaatgaaaatctacaaatttcttctagagcacttcacagatgaacagcgattcaacatcacttccaaaatctgccttagtattttggcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagttcagaagaggaatttcatagaaaatattattccaattatcatctccctgaagactgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggttgccctgtgtttagaaacagtgccagttcctgctggccaagaaaaccctgccatgtcacctgccgtgagccagccctgcacacccagggcaagtgctggccatgtagcagtatcatctcctacacctgaaacagggccattgcagaggttgctgcccaaagccaggcccatgtccctgagcaccattgcaatcctgaattctgtcaagaaagccgtggagtcaaagagcaggcatcggagtcggagcttaggagtgctgcctttcactttaaattctggaagcccagaaaaaacgtgcagtcaggtgtcttcatacagtttggagcaagagtcgaatggcgagattgagcacgtgaccaagcgggccatcagcacccccgagaagagcatcagtgatgtcacgtttggagcaggggtcagttacatcgggacaccacggactccgtcgtcagccaaagagaaaattgaaggccggagtcaaggaaatgacatcttatgtttatcactgcctgataaaccgcccccacagcctcagcagtggaatgtgcggtctcccgccaggaataaagacactccagcctgcagcaggaggtccctccgaaagacccctctgaaaacagccaactaaacagcgcctcccaccagtgtccaggcaggcaggagcccttgaggaagcagtctcgtgtcctccgtgtgaaggcagctggatcacttcccgcagtccttgggcagcgctttgctgtggaacacgagagctcctcctcaggggcctggcactcaccttctattctgtatgatgtatttggttaaacactgtcaaataatagagatgtgccagatttagattttcttaccctaatctgtttaatattgtaactttattccatttgaaagtgtcaagcccattcagataagctataatctggtctttaaggaacacaactttaaaactgcagctttcttttatataaatcaagcctctgttaacttgaattccttatagtacatattttcccatctgtaatgacgaaattttgattctaatattttttctattatttataagtgcaaattttttaaaaaagtgtacagctttctaaaagtaataaaggtttagcataaatacagccaaaaaaaaaaaaaaaaaaaaaaaaaaaaaaaaaaaaaaaaaaaaaaaaaaaaaaaa

SEQ ID NO: 107 - DNA, 3172 bp, Homo sapiens
actgcactgctggctgcagacacaggctgcaccatgaagccagccctcctgccctgggccctgctgctgctggcgacagccctcggcccgggccccggacccacagcagatgcccaagagagctgctccatgcgctgtggcgccctggacgggccatgttcctgccacccgacgtgctctggccttggcacctgctgcttggatttccgggacttctgcctggagatattgccctactcaggatccatgatgggcggcaaggactttgtggtgcggcacttcaagatgtccagccccacagacgccagtgtgatctgcaggtttaaggacagcatccagaccctcggccatgtggactcctccgggcaagtgcactgtgtgtcacctctgctctatgagagcggccgcatccccttcactgtgtcactggacaacggccactccttccctcgtgcgggcacctggctggctgtgcaccccaacaaagtgtcaatgatggagaagagcgagttggtgaacgagacgcgttggcaatactacggcaccgccaacacctcaggcaacctcagcctgacctggcatgtcaagtcgctgcccacgcagaccatcaccatcgaactgtggggctacgaggagacaggaatgccctactcacaggagtggactgcaaagtggtcgtacctgtaccccctggccacacacatccccaactccggctctttcactttcaccccaaaacctgctcctcccagctaccagagatggcgagtgggtgcacttcggatcatcgacagcaaaaattacgcagggcagaaggacgtgcaggcgctctggaccaacgaccacgcactggcctggcacctgagcgatgacttccgagaggaccctgtggcctgggcacgaactcagtgccaggcctgggaggagctggaggatcagctgcccaacttcctggaggagctgccggactgcccctgcaccctgacccaggcccgggctgactccggccgcttcttcacggactacggctgtgacatggagcagggcagcgtgtgcacctaccaccccggggccgtgcactgtgtgcgttctgtgcaggccagcctccggtacggctcaggtcagcagtgctgctacacagcggacgggacgcagctcctgacagctgactccagcggcggcagcactcccgaccgcggccatgactggggcgcacccccgttccgcacgccaccccgagtgcccagcatgtcccactggctctacgatgtcctcagcttctattactgctgcctctgggcacccgactgcccccgctacatgcaacggcggccctccaatgactgccgcaactaccggcccccaagactggcctccgccttcggagacccacactttgtgaccttcgacggcaccaacttcacattcaatgggcgcggagagtacgtgctgctggaggcagcgctgaccgacctgagggtgcaggcgcgggcccagcccgggacgatgtccaacggcacggagacccgtggcactgggctgaccgcagtggccgtccaggagggcaactcagatgtggtggaagtcaggctggccaacaggaccggaggtctggaggtgctgctgaaccaggaggtgctgagcttcaccgagcagagctggatggacctgaaaggaatgttcctgtcggtggctgccggggacagggtctccatcatgctggcatcaggggccggcctggaggtcagcgtgcagggcccgttcctgagtgtgtccgtcctgctgcctgagaagttcctcacccacacccacggcctcctcgggacactcaacaacgaccccaccgacgacttcaccctgcacagcgggcgcgtcctgcccccaggcaccagtccccaggagctgttcctgtttggggccaactggaccgtgcacaatgcgtcctccctgctcacctacgattcctggttcctggtccacaacttcctgtaccaacccaagcacgaccccaccttcgagcccctcttccccagtgagaccaccctcaaccccagcctggcacaagaggcagccaaactatgtggggacgatcatttctgcaactttgatgtggcagccactgggagcctgagcacgggcactgccactcgggtggcccaccagctgcaccagcgtcgcatgcagagcctgcagccagtggtgtcctgtggctggctggccccacctcccaacggacaaaaggagggcaacaggtacctggcgggttccaccatctacttccactgtgacaacggctacagcctggccggggcagagaccagcacctgccaggctgacggcacctggtcctcacccaccccgaagtgccagccaggacgcagctacgcggtgctgttgggcatcatctttgggggcctcgcggtggtggcggcggttgcgctcgtctatgtgctgctgcgccgcaggaagggcaacacgcacgtctggggtgcacagccctgatgggagcagcttggctgtgagcaccaggccaagactcctgagaacaggcagcccagtcctgcgactcccgcatccccaggaccagacacctgggacctggatacttgatacctgggcatttaaccccctactctgtcatctcagaccccaggcaggaggcccagtgttccaacacccaagccccgtgctagcagcgctccgtgctcttccccaaatactcacggctctaattccccaaacctgaaacttcataccctgggattctaatacctatgtcctgagccctgacactcccacacctgagcctcagattccaatagctcactccctagagcctgacgccggggcccctgacccctgagcctcagattccaatacctcactccccagagcctgatgccggggcccctgacccctgatctacggaggcctgctcccggaccgtgcgggcaccagtgcagtgctgccttggttcctggacccctgggcccatcctgggaccccagatggggtaaggagaggccccagaaccccaaagcagacagcgagacccccagcggcagaggcctccctcggcactccaggcttataatttcgaactcttctggaaggtcactcaggaacaccctccctgcctgtgcaaagagaaaacaagcgccttgtttccttc

SEQ ID NO: 108 - DNA, 4684 bp, Homo sapiens
agccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatggtactccagaggttgaaacaacaagcctcaatgatgttactttaagcttactcccttcaaacgaaacagaaaaaactaaaatcactatagtaaaaaccttcaatgcatcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaagatctttaa

SEQ ID NO: 109 - DNA, 1781 bp, Homo sapiens
agtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgagaata

SEQ ID NO: 110 - DNA, 3153 bp, Homo sapiens
ctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacgtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcacca

SEQ ID NO: 111 - DNA, 7796 bp, Homo sapiens
ggggccggggggcggagccttgcgggctggagcgaaagaatgcgggggctgagcgcagaagcggctcgaggctggaagaggatcttgggcgccgccagtctctctctgttgcccaagctggagtgcagtggcacagtcttggctcactgcaacctccacctcctgggtgcaagcgattctcgtgtctcagcctctcaagtagctgggattacagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcgggggggtggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccatagtggccataccaaagaggctaccgattccttcctgctacctggatccctgaagttgccctggtctctgcaccttctaaacctagttcttaagagctttccattacatgagctgtctcaaagccctccaataaattctcagtgtaagcttctgttgcttgtggacagaaaattctgacagacctaccctataagtgttactgtcaggataacatgagaacgcacaacagtaagtggtcactaagtgttagctacggttattttgcccaaggtagcatggctagttgatgccggttgatggggcttaaacccagctccctcatcttccaggcctctgtactccctattccactaaactacctctcaggtttatttttttaaattcttactctgcaagtacataggaccacatttacctgggaaaacaagaataaaggctgctctgcattttttagaaacttttttgaaagggagatgggaatgcctgcacccccaagtccagaccaacacaatggttaattgagatgaataataaaggaaagactgttctgggcttcccagaatagcttggtccttaaattgtggcacaaacaacctcctgtcagagccagcctcctgccaggaagaggggtaggagactagaggccgtgtgtgcagccttgccctgaaggctagggtgacaatttggaggctgtccaaacaccctggcctctagagctggcctgtctatttgaaatgccggctctgatgctaatcggcgaccctcaggcaagttacttaaccttacatgcctcagttttctcatctggaaaatgagaaccctaggtttagggttgttagaaaagttaaatgagttaagacaagtgcctgggacacagtagcctcttgtgtgtgtttatcattatgtcctcagcaggtcgtagaagcagcttctcaggtgtgaggctggcgcgattatctggagtgggttgggttttctaggatggaccccctgctgcattttcctcattcatccaccagggcttaatggggaatcaaggaatccatgtgtaactgtataataactgtagccacactccaatgaccacctactagttgtccctggcactgcttatacatatgtccatcaaatcaatcctatgaagtagatactgtcttcattttatagatcagagacaattggggttcagagagctgatgtgattttcccagggtcacagagagtcccagattcaggcacaactcttgtattccaagacacaaccactacatgtccaaaggctgcccagagccaccgggcacggcaaattgtgacatatccctaaagaggctgagcacctggtcaggatctgatggctgacagtgtgtccagatgcagagctggagtgggggaggggaaggggggctccttgggacagagaaggctttctgtgctttctctgaagggagcagtctgaggaccaagggaacccggcaaacagcacctcaggtactccaggccctcctggctggagagggctgtggcaatggaaaattagtgccaactgcaatgagtcagcctcggttaaatagagagtgaagaatgctggacaggaacctccaccctcatgtcacatttcttcagtgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatctttcaactgaccctgatcaacgaagagggacttgtgtctctcagttggttccaaatgaaaccagggagcaggggcgttaggaagctccaacaggatggtacttaatggggcatttgagtggagaggtaggtgacatagtgctttggagcccagggagggaaaggttctgctgaagttgaattcaagactgttctttcatcacaaacttgagtttcctggacatttgtttgcagaaacaaccgtagggttttgccttaacctcgtgggtttattattacctcatagggactttgcctcctgacagcagtttatgggtgttcattgtggcacttgagttttcttgcatacttgttagagaaaccaagtttgtcatcaacttcttatttaaccccctggctataacttcatggattatgttataattaagccatccagagtaaaatctgtttagattatcttggagtaagggggaaaaaatctgtaattttttctcctcaactagatatatacataaaaaatgattgtattgcttcatttaaaaaatataacgcaaaatctcttttccttctaaaaaaaaaaaaaaaaaa

SEQ ID NO: 112 - DNA, 1980 bp, Homo sapiens
agtgggctccacctacccgctccggcccttcccaccaccccccaccccatctactttctacagtctgtggagacaggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagccacaaaaaaaaaaaaaaaa

SEQ ID NO: 113 - DNA, 3830 bp, Homo sapiens
cttcttcagccactgcgaggtgaagctttaaacttcagacttggaggtgggctgtgtgcagtaaactggaatgctctccctcgctcactcctcagtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctgggttctgaagtaacggaagctaccttgtataaagacctcaacactgctgaccatgatcagcgcagcctggagcatcttcctcatcgggactaaaattgggctgttccttcaagtagcacctctatcagttatggctaaatcctgtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaccaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctataaagtatgcatggttcccatggaaaccagcaacctctacctatttgatgaaactcctgtttgtattgagactgaaactgcaccccttcgaatgtacaaccctacaaccaccctcaatcgagagcaagagaaagaaccttacaaaaaccccaatttacctttggctgccatcattggtggggctgtggccctggttaccattgcccttcttgctttagtgtgttggtatgttcataggaatggatcgctcttctcaaggaactgtgcatatagcaaagggaggagaagaaaggatgactatgcagaagctggcactaagaaggacaactctatcctggaaatcagggaaacttcttttcagatgttaccaataagcaatgaacccatctcgaaggaggagtttgtaatacacaccatatttcctcctaatggaatgaatctgtacaaaaacaatcacagtgaaagcagtagtaaccgaagctacagagacagtggtattccagactcagatcactcacactcatgatgctgaaggactcacagcagacttgtgttttgggttttttaaacctaagggaggtgatggtaggaaccctgttctactgcaaaacactggaaaaagagactgaaaaaaagcaatgtactgtacatttgccatataatttatatttaagaactttttattaaaagtttcaaatttcaggttactgctgcgattgatgtagtggagatgcctgaacacaattctatattttagtattttttagtaatttgtactgtattttccttgcaaatattggagttataaaccatttactttgtgttctactgagtaagatgacttgttgactgtgaaagtgaattttcttgctgtgtcgaacaatcaggactgcattcatatgagatccttgtagtataagcacaggccatttttcactttggtattaataaaatgtaaaaaaaaaaaactggctgaatggctgaatgagataaaatttaattttaaaaaatggttatgaaataatgttccaattattaaatttgtattatcccagtggtattcaataaatcaaaatgtgtgaagtaatgggcaatatcaaacttcctgcatatctccatttttgctctaggcaaattaattatccttaaaaaagttaagcatatcttctgaactgaatacatcagctggcataaaaggagcatgaagtctgttaaagccattgtcagcaaagctttgaaaataaaggacttcacaaaaacggtaatgtaaatgtgcttccaagttggggggaaaatgtgtacttaggaaaacatggaaacttagacttgtatagtgtaatgaacacaaataccaaaactgcattttggttttgcctataccatcctgatttttgaaaagtgaattataaacacaaaattgttagtgtttatgatgtttttatcataaaggatgtcagagaaactttatgcatattaaaaatgtaatgtaattataagcgattcccctcaacaatccagagaaagtagttctttaaataagagataatttaaagaaaaataaatactagacatcaaatttagatctggtttatgtcaaaggttttaacactgtacataaatgttcaatttacttttacaaagatcaagaatactgcccattactgtcacaattttccagatattatataatgaactcgtaatgtaacatttccttctagcttcctactgaattgtgagctgttacttgttgaaaaaccatatcacttttctgttgccatgattttttttttttcaacaaaaaaccaaagtgcattgtacgccctttggccagtcttgtatgtgccttgatccaacgctacatgtattcagcttttaaaactccacaaatttttcatactccttaaatatgaaaaattatggtcttattgctgaataaaacttttaaaaagtacagaataattgtgcttgctttttcaggattgtgttactatcactaagtagcaaattgcccagcacattagtcctaaacgtcccatgtatttttctaggcataaaaataaaagttggctaaaaattttaaaaaatcaaca

SEQ ID NO: 114 - DNA, 3024 bp, Homo sapiens
aggatatctttagccaaaggaaaagctccgcattcccacccagtccagaaattgaaatactatcagggggcaagagcctttctctccagctacacactccatctcccgggagcaaggggaaactccgagaggagggcaacagagccagcatcttgccagggccccggaggaggggttccccgctacgcctgtgccggaggagttccagtcaccgagcgaggggcgcaagggtgggtgcatcctgcgctgcggcgggcgcgctacccagacgctggtgtgcagagccacatgaagcctgctggggactgggggccagggagcagcaagccagctgggactgaggcggacgctgtctcagggagacgctgactcgcaaagacactcccttccttgtgcctgggtaaaaagtctcctcctggggtccctggccatcctgaatatccagaatggtgtttctgaagttcttctgcatgagtttcttctgccacctgtgtcaaggctacttcgatggccccctctacccagagatgtccaatgggactctgcaccactacttcgtgcccgatggggactatgaggagaacgatgaccccgagaagtgccagctgctcttcagggtgagtgaccacaggcgctgctcccagggggaggggagccaggttggcagcctgctgagcctcaccctgcgggaggagttcaccgtgctgggccgccaggtggaggatgctgggcgcgtgctggagggcatcagcaaaagcatctcctacgacctagacggggaagagagctatggcaagtacctgcggcgggagtcccaccagatcggggatgcctactccaactcggacaaatccctcactgagctggagagcaagttcaagcagggccaggaacaggacagccggcaggagagcaggctcaacgaggactttctgggaatgctggtccacaccaggtccctgctgaaggagacactggacatctctgtggggctcagggacaaatacgagctgctggccctcaccattaggagccatgggacccgactaggtcggctgaaaaatgattatcttaaagtataggtggaaggatacaaatgctagaaagagggaatcaaatcagccccgttttggagggtgggggacagaagatggggctacatttcccccatacctactatttttttatatcccgatttgcactttgagaatacatctaaggtcatctttcaaaagagaaaaattggacacttgagtgactttgtttttagttttgtttttgtacattatttatgtgattgttatggaattgtcacctggaaagaacaattttaagcaatgtcatttctagatgggtttctaattctgcagagacacccgtttcagccacatctaaaagagcacagtttatgtggtgcggaattaaacttccccatcctgcagattatgtggaaatacccaaagataatagtgcatagctcctttcagcctctagccttcactcctgggctccaaaagctatcccagttgcctgtttttcaaatgaggttcaaggtgctgctttgcatgcctgccaacccatggaagttgtttcttacttcttttctctcttatttattaaccatggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaaacttgtacttcaagtagggggaatcctaattctaataactccttagctaagttttattattcaggcaataaacatgttttcatgtaatactggcttactttgtaatttacatctgtaactttcatatttctaaaaggggccaatgcaaaaggagagagaaggactggatttaagccagtttacttagagtatatgataaagaaggcagaggaatagctacatatttggcaattctcctctctgtagtcaccctgacatcctcacaagaaaacaaatctagccattgcccaaactttaaatttgatctctataggtctgcttaaagactcaaattttctccagtttctctcataaattcaattgcaaaagtttctgacaaggctcataccctgtacccttatgcagagcaagcattccatcctaagttataaactacagtgatgtttaattttgaagccaggtctacattatttaattaatggcttcaaaaggtggagatgcactttatttaatgtctttccctagctaattcttactctcaccttaaatatgctttcttgttgcatatatgcacagatacacacacacacacacacgaaaataaataaatgttcatattcttctgttcaacagacatttattttctcctctcccttgaataagaaaataagttttccattcctatgaactgtctaatatctttctattacagaaggggaaactgaggctgggaaaggctaaatgacttatcctccatcagttataacagcccctggtcttcttaaatttaaacacgggacttcccgaactaatttttttaaggatactgaaaaatgagagagagtggtcgaatgcctgaaattttgcttaacttactgtacttaaaatcaattataacttctttttgttactcagggccccactttttgttgctttctagacttgtgtgtagaaagaagattaatgatcacttaaagtagtttccttctttattctgaaaaaatgaggaaaaaataacaacagtggcaaataaaatcatatttggtactaaaaaaaaaaaaaaaaaaaaa

SEQ ID NO: 115 - DNA, 5593 bp, Homo sapiens
acggatccgcgttcagaaaggcgtgcacttcctacgcctgatcccccgcatcgcaacctcgcagcttccccggcgtgcagcgctcatttaccaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaatgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatgaaaaaaaaaa

SEQ ID NO: 116 - DNA, 4653 bp, Homo sapiens
cccaaaccaacttgtccccatcaactccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaaaaatcagaaattggagaaatccttagcacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctatggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtggtggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctccctcccttccagcagcgacccagcttccctccacttccaggtggtgctgggctcaccgagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaatggcaaaaaaaaaaa

SEQ ID NO: 117 - DNA, 3577 bp, Homo sapiens
agtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttctaacaaatctgtgatgttctgatttctaagggactttgcaagtattttgattgctgatatttgatttcaggaacaaactgctcagtttagcagttttcccataggcgtcaaataaaacattctatatttcattaagta

SEQ ID NO: 118 - DNA, 3744 bp, Homo sapiens
agttgcccgcctgccccggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaataattcttcagagttc

SEQ ID NO: 119 - DNA, 12716 bp, Homo sapiens
agaaggaagtggagggctgacgctgcgggcgggcgggcgggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtcttaaaa

SEQ ID NO: 120 - DNA, 3122 bp, Homo sapiens
gcggccgcccagagcggcggcgggggcggcggggcgcggggcgcgggggcccagctgagccggccgtcggagtgagaccctgcggcagagacgacggaggcggaagcaacccgatcccggaggcggcggcggcggggggagccggagccgcctgggatgttcagtcatgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacagtgcaatcagaatctggttgtgccaacatagtgtctgcagccccttgccaggcagaaccccagcaatatgaagtacagtttggacgactgcggaattttctcactgattctgattcccagcatagccacgaagtgatgcctctcctctatcctctctttgtctacctccatctcaacctggtccaaaacagtccgaagagcacagtggaaagtttttacagccgcttccatggaatgtttctgcagaatgctagccagaaggatgtcattgagcagctacagaccactcaaaccatccaggacatcctatctaacttcaagcttcgagcattcctagataacaagtacgtggtccgtctccaagaagacagctacaactaccttatccgctacctccaaagtgacaacaatactgccctgtgcaaagtcctcaccttacatattcatcttgacgtgcagcctgccaagagaacagactatcagctgtatgccagtggcagctcctcccgcagtgagaacaacggtttggagccccccgacatgcccagccctattctgcagaacgaggctgccctagaggtcttacaggagagcattaagcgagtcaaggatgggcctccctccctcactaccatctgcttctatgccttctataacacagagcagctgttgaacactgcagaaatctcccccgatagcaagctgcttgctgctgggtttgacaactcctgtataaaactttggagtttacgatccaagaagttaaaatcagagccccaccaagtagacgtgtcccgcatccatttggcttgtgatattctggaggaggaggatgatgaggatgataatgcaggcacggagatgaagatactgcggggccactgcggaccagtgtacagcacgaggttcctcgcggacagctcagggttgctctcttgttctgaagacatgtccatcagatactgggatctggggagtttcaccaacactgtgttgtaccaaggacatgcctatcctgtgtgggatctggacatcagtccatatagcctgtacttcgccagcgggtcccacgaccgcaccgccaggctgtggtcatttgatcggacgtacccgctgaggatatatgcaggacacctggcagatgtggactgtgtcaaattccaccctaattcaaactacttggccacgggctcaaccgacaagaccgtccggctgtggagcgctcagcaggggaactcggtgaggcttttcacaggccaccgtggccccgtgctttctctcgccttttctcccaacggtaagtacttggcgtctgctggcgaggaccagcggttgaagctgtgggacttggcctctgggaccctttataaagagttgagaggccacacagacaatatcaccagcctcaccttcagtccagacagcggcttgattgcctctgcctccatggacaactcggtgcgcgtctgggacatcaggaacacttactgcagtgcacctgccgacggctcctccagcgagctcgtgggcgtgtacaccgggcagatgagcaacgtcctgagcgtgcagttcatggcctgtaaccttcttctggtgactggaattacacaagaaaatcaggaacattaattttttaactttgttggaacggactggggtaacagtggaaagcctccagttgcaatccttcaatgagctgagattgaatcattgactgtgaaagagccccctcctcccctctctcctgggccctcattccgggcaggtcccccttcactcagccccccagtgtcgaaggccaaggttggggaggggaacaggagagaggcaatgatgagtgatcaagaattagagtgccctggaggtcactcacaagtcctcatggagactctgccgtgacctcgcgcatgcgagcaccttcctgtctctcattttcaccatctgactggggctaggtttggttagagggcggctgtagagcaccctcaggagaagtggcgccgcaggggtcacgcatggtccagccctcaggtgggagggaagtccttgttggcagagggatgtggggcgggaatgaggaaaggggagggcatgatcctggcaaatagtctttccttttccgtaattacagagaaccaggattttttttaattattgttattataattataattattattattattgacatgaggaaacctagcactggcagagggcaccttctctgcttttaatctttcaggtttgactcctggcactggttttgatacttggaattttgaggttcagggaattcagagaatttggtagcacagtgtattgggagaaagggaaatttcgggtgacagattgatcaccctggctgacatgtttctggaagtgggtgggtgggtttgattgagaacactttgggctcctgcagtgatggtgggaaagaaaaattctttccaaagctgcacttctcttaataattctctcccctcaaaagaaagattatgataaagaataatttggagtaataagtaacaagatagaattagaaaaatgttgaatttctgaatgaccattcagaggtgtggctttttccacgtctttttctcctgcaatgaactgctcccacgtcctgcactgcaataccagtctaatgaacactttgtgaaacaaatcgtaagtatgtacgcacgcatatcaaactatgctctgaggataaagcaagttctaatttgtggaaaaaggattaaatatttctgttttctgaaaagagttattttgtattttgttttctattaaaatgtatttagtttcaaaaaaaaaa

SEQ ID NO: 121 - DNA, 7685 bp, Homo sapiens
agatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaatgacaatatagagagacctgttagaagacggcattcttcaatattgaaacccccaaggagtcctcttcaggacctcagaggtgggaatgaaagagttcaggaatccaatgctttgagaaataagaaaaactctcgtcgagtcagctttgcagatactataaaggtattccagacggagtctcatatgaaaatagtgagaaagtcagaaatggaaggctgcagtgcaatggtgccatctcagctgcaacttctgcctcctgggtttaagcgattctcctgcctcagcctcccagaaacagaaacaggagaaaatcttcttttgatacagaataagaaattagaagataattactgtgaaattactgggatgaacacattgctttctgctcccattcatacccagatgcaacagaaggagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattatgctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatcttatgaccacatcagaagatgggaaaatgaatgtaaattgtaactcagttcctcatgtatctaaggaaagaatacagcagagcctgtcaaatcctttgtctatttcattgactgatagaaagactgaactcttatcaggtgaaaatatggatttgactgaaagtcacacaagtaacttaggaagtcaggttcctcttgcagcttataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatatagtctactgtggtggagttcttgataaacaaataactaatagaaatacagtatcatgggaacaatctttgttttctaccacaaagccattattttcatcaggacagttctctatgaaaaatcatgatactgctataagtagtcatacagtgaaatctgtactaggccagaattctaaactggctgagccactgaggaaaagtttaagcaatcccacacctgactattgccatgacaagatgattatatgttcagaggaagagcaaaatatggatctaacaaagagccacactgtcgtcattggatttggtccttctgaactacaagaacttggtaaaactaatttagaacacactactggccagctaacaacaatgaacagacagatagctgtaaaagttgaaaaatgtggtaaaagtcccatagaaaaaagtggagtgcttaaatctaactgtattatggatgtgttagaggacgaaagtgtacagaaacctaaatttccaaaggaaaagcaaaatgtcaaaatttggggaaggaaaagtgttggtggaccaaaaattgataagactattgtattttcagaagacgataagaatgatatggatatcactaagagttatacaatagaaataaaccatagacctttattagagaaacgtgattgtcatttggtgccattggcaggaacttctgaaactattttatatacatgtaggcaggatgacatggagatcactagaagtcacacaactgccttagaatgtaaaactgtctcaccagatgaaataactactaggcctatggacaaaactgtagtgtttgtagataatcatgttgaactagaaatgacagagtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtctaaatcagccacttgcaaaaacatcaaagatgtacaaagtcctggatttctgaatgaacctctatcaagcaaaagtcagagaagaaaaagccttaagctaaaaaatgacaagaccattgtattttcagagaatcataaaaatgatatggatattacccagagttgtatggtggaaatagataacgaaagtgccctggaggataaagaggacttccatttggcaggggcttctaaaactattttgtattcatgtgggcaggatgacatggagatcactaggagtcacacaactgccttagaatgtaaaactctcctgccaaatgaaatagctattaggcccatggacaaaaccgtattgttcacagataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcatagggaaagttgtagaccaggcctgtacattggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcaaccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctattaacatagaaactgaggaaaaggccttgattgagacataccaaaaagagatttcaccatatgaaaataaaatgggaaaaacttgcaatagccaaaaaagaacgtgggtacaagaagaagaagatattcataaggagaaaaaaatcagaaaaaatgagattaagtttagtgatacgacacaagatcgggagatttttgatcaccatactgaagaggatatagataaaagtgctaacagtgtattgataaaaaacctgagcaggaccccatctagttgcagcagctctctggattcaatcaaggctgatgggacctctctggacttcagcacttaccgcagtagtcaaatggaatcacagtttctcagagatactatttgtgaagagagcttgagggagaaactccaagatgggagaataacaataagggagttctttatacttctccaggtccacatcttgatacagaaaccccgacagagcaatctcccaggcaattttactgtaaacacaccacctactccagaagacctgatgttaagtcaatatgtttaccgacccaagatacagatttatagagaagattgtgaggctcgtcgccaaaagattgaagaattaaagctttctgcatcgaaccaagataagctgttggttgatataaataagaacctgtgggaaaaaatgagacactgctctgacaaagagctgaaggcctttggaatttatcttaacaaaataaagtcatgttttaccaagatgactaaagtcttcactcaccaaggaaaagtggctctgtatggcaagctggtgcagtcagctcagaatgagagggagaaacttcaaataaagatagatgagatggataaaatacttaagaagatcgataactgcctcactgagatggaaacagaaactaagaatttggaggatgaagagaaaaacaatcctgtggaagaatgggattctgaaatgagagctgcagaaaaagaattggaacagctgaaaactgaagaagaggagcttcaaagaaatctcttagaactggaggtacaaaaagagcagacccttgctcaaatagactttatgcaaaaacaaagaaatagaactgaagagctactggatcagttgagcttgtctgagtgggatgtcgttgagtggagtgatgatcaagctgtattcacctttgtttatgacacgatacaactcaccatcacctttgaagagtcagttgttggtttccctttcctggacaagcgttataggaagattgttgatgtcaattttcaatctctgttagatgaggatcaagctcctccttcctcccttttagttcataagcttattttccagtacgttgaagaaaaggaatcctggaagaagacatgtacaacccagcatcagttacccaagatgcttgaagaattctcactggtagtgcaccattgcagactccttggagaggagattgagtatttaaagagatggggaccaaattataacctaatgaacatagatattaataataatgaattgagacttttattctctagctccgcagcatttgcaaagtttgaaataactttgtttctctcagcctattatccatctgtaccattaccttccaccattcagaatcacgttgggaacactagccaagatgatattgctaccattctatctaaagtgccactggagaacaactacctgaagaatgtagtcaagcaaatttaccaagatctgtttcaggactgccatttctaccactagacccttggaccaccattggaacaaccaagcagaatgtacttgatattatttcagggtcccattgctgttcagcctttgtttttacgtcattacaagctgagtaaaattccttctgatgatgttatagttaatctgtatgttttttatatctctgcagaatgatggtgatgaagtctggatggtaggcctcatagcctactatcaacttactcatctttgtaccaaaggtttaagtaataggacacttaggaaaaatgtctcctaactaaactagtgctttctgctttagtacaagccctaaggattaacttaagtataagaagtgttatcactgacaagaacattagccattttcccataactagatagagctatgattttttaggttgcctggcttctgcctagcagatatttctggagtagaaatgtatctgtctacaaactattatcctttttctccgttactaaaatgctattaagagaaagtagggctgg

SEQ ID NO: 122 - DNA, 1615 bp, Homo sapiens
gttgacccgcggcgttcacgggaattgttcgctttagtgccggcgccatggggtcggagctgatcgggcgcctagccccgcgcctgggcctcgccgagcccgacatgctgaggaaagcagaggagtacttgcgcctgtcccgggtgaagtgtgtcggcctctccgcacgcaccacggagaccagcagtgcagtcatgtgcctggaccttgcagcttcctggatgaagtgccccttggacagggcttatttaattaaactttctggtttgaacaaggagacatatcagagctgtcttaaatcttttgagtgtttactgggcctgaattcaaatattggaataagagacctagctgtacagtttagctgtatagaagcagtgaacatggcttcaaagatactaaaaagctatgagtccagtcttccccagacacagcaagtggatcttgacttatccaggccacttttcacttctgctgcactgctttcagcatgcaagattctaaagctgaaagtggataaaaacaaaatggtagccacatccggtgtaaaaaaagctatatttgatcgactgtgtaaacaactagagaagattggacagcaggtcgacagagaacctggagatgtagctactccaccacggaagagaaagaagatagtggttgaagccccagcaaaggaaatggagaaggtagaggagatgccacataaaccacagaaagatgaagatctgacacaggattatgaagaatggaaaagaaaaattttggaaaatgctgccagtgctcaaaaggctacagcagagtgatttcagcttccaaactggtatacattccaaactgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctacaaaatggaattggaggccgggcgcagtggctcacgcctgtaatcccagcactttgggaggccaaggtgggtggatcacctgaggtcaggagctcgagaccagcctggccaacatggtgaaaccccatctctactaaaaatacaaaaattagccaggtgtgatggtgcatgcctgtaatcccagctcctcagtaggctgagacaggagcatcacttgaacgtgggaggcagaggttgcagtgagccgagattgcaccaccgcactccagcctgggtgacagagcgagacttatctcataaataaatagatagatactccagcctgggtgacagagcgagacttatagatagatagatagatagatggatagatagatagatagatagatagatagataaacggaattggagccattttgctttaagtgaatggcagtcccttgtcttattcagaatataaaattcagtctgaatggcatcttacagattttacttcaatttttgtgtacggtattttttatttgactaaatcaatatattgtacagcctaagttaataaatgttatttatatatgca

SEQ ID NO: 123 - DNA, 594 bp, Homo sapiens
aggctcactataaatagcagccacctctccctggcagacagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcagcaatgccagagagaatatccagagactcacaggccgtggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtggaatttgttgaaaca

SEQ ID NO: 124 - DNA, 5246 bp, Homo sapiens
cgtcacgtcatggcgcgcctcggtggcgtcagagcggcgtcgggcctggcgggaaagtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggtatctctacaaaacccaccagagtctggcactgatggttgcattttgttaattgttctaagttggtggagcagaactttgcctacttatgtttattgtcaaatgcttctatgcccatttccattccctccataacagcttctgtgcttatataatttttgggacccagaagaaacaacgacacaatcttagaatcactcctgagtatctcgagttgtggcatttgttatagagttgacaattttctgcattatagcctctcattttccatgaattcatatctgaaaccattttagaagggagaagtcatcgaagtattttctgagtgttgagaagaatgagttaaaccatttaaacacatttgaaacatacaaaaatagaaatgtgaaagcatttggtgaaagccaaagcacagagtcagaagctgccaccttagagaactgaaataaaaatagaagttcttacgcttttttgtggtacagatgctttcgacaatttaaagaaagctaaataaaaatgtagacatggctggcgcagtggctcatgcttgtaatcctagcactttttgaggccaaggtaggaggattgcttgagtccgggagctcaaggcaaagctgcacaacataacaagaccctatctccacaaaaaaaatgaaaaataaacctgggtgcggtggctcacacctgtaatcccagcactttgggaggccgatgtgggcagatcacaaggtcaggagttcaagaccagcctggccaacatagtgaaaccccatctctactgaaaatacaaaaattagctgggtgtggtggcacgtgcctgttatctcagctacttgggaggctga

SEQ ID NO: 125 - DNA, 4966 bp, Homo sapiens
gtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccgcacctccgctgtcctcccctccaggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccgacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatcccccacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaagaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttaaagagacagggctttgctgaaaaccaaacatgggccagctgggctttttaacaacctagagactttccggagctgcctggaacagagcctgcgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatggatggatggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgatgaaaaaaaaaaaaaaaaa

SEQ ID NO: 126 - DNA, 5019 bp, Homo sapiens
agttcccgcgaccccaacgtcccagaggcggggccggagtcggcggtggcgctccttggagccggctcccgctcctaccctgcaaacagacctcagctccgcggaagttgcggatactgaggatttggaattaaagaaatcattcaccagacatcatggagcctatatatccttttgcacggccccagatgaataccaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaacagctcttctctagttgtgagaaaagaacctgatgtacctgtgttctttccaagtggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacctgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgcccgcctcggcctcctaaagtgctgggattacaggcgtgagccactgcgcccagctatactgtatattttaagaagttccagcatgttgcatctctgcatttatcctatatcattaaaagaacataagttatcatggtgttgggtaaattagcgaaatcaacccttcctaagtttaagggaaaagttatttttaaaaacaacttaataaaaacttacactcttttatacaagagtgtatttccccttaattaggatgcatgttgattaaactcgagatacagctttttgcagtatggtgggttggttttggtgtaacatcttcaacatgtcacactggctatcaaagaataagaaaattattgagtatgagtgtgttttataaactttctgagtttttcagatgtcttaatattttttaatagaacttaataaaatgtctagattgactattttc

SEQ ID NO: 127 - DNA, 4360 bp, Homo sapiens
agtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcaagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcatacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaattacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctatta

SEQ ID NO: 128 - DNA, 5829 bp, Homo sapiens
ctttcctagagtctctgaagccacagatctcttaagaactttctgtctccaaaccgtggctgctcgataaatcagacagaacagttaatcctcaatttaagcctgatctaacccctagaaacagatatagaacaatggaagtgacaacaagattgacatggaatgatgaaaatcatctgcgcaagctgcttggaaatgtttctttgagtcttctctataagtctagtgttcatggaggtagcattgaagatatggttgaaagatgcagccgtcagggatgtactataacaatggcttacattgattacaatatgattgtagcctttatgcttggaaattatattaatttacatgaaagttctacagagccaaatgattccctatggttttcacttcaaaagaaaaatgacaccactgaaatagaaactttactcttaaatacagcaccaaaaattattgatgagcaactggtgtgtcgtttatcgaaaacggatattttcattatatgtcgagataataaaatttatctagataaaatgataacaagaaacttgaaactaaggttttatggccaccgtcagtatttggaatgtgaagtttttcgagttgaaggaattaaggataacctagacgacataaagaggataattaaagccagagagcacagaaataggcttctagcagacatcagagactataggccctatgcagacttggtttcagaaattcgtattcttttggtgggtccagttgggtctggaaagtccagttttttcaattcagtcaagtctatttttcatggccatgtgactggccaagccgtagtggggtctgatatcaccagcataaccgagcggtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcagtttaattcccgtaaaccaattacacctgagcattctacttttatcacctctccatctctgaaggacaggattcactgtgtggcttatgtcttagacatcaactctattgacaatctctactctaaaatgttggcaaaagtgaagcaagttcacaaagaagtattaaactgtggtatagcatatgtggccttgcttactaaagtggatgattgcagtgaggttcttcaagacaactttttaaacatgagtagatctatgacttctcaaagccgggtcatgaatgtccataaaatgctaggcattcctatttccaatattttgatggttggaaattatgcttcagatttggaactggaccccatgaaggatattctcatcctctctgcactgaggcagatgctgcgggctgcagatgattttttagaagatttgcctcttgaggaaactggtgcaattgagagagcgttacagccctgcatttgagataagttgccttgattctgacatttggcccagcctgtactggtgtgccgcaatgagagtcaatctctattgacagcctgcttcagattttgcttttgttcgttttgccttctgtccttggaacagtcatatctcaagttcaaaggccaaaacctgagaagcggtgggctaagataggtcctactgcaaaccacccctccatatttccgtaccatttacaattcagtttctgtgacatctttttaaaccactggaggaaaaatgagatattctctaatttattcttctataacactctatatagagctatgtgagtactaatcacattgaataatagttataaaattattgtatagacatctgcttcttaaacagattgtgagttctttgagaaacagcgtggattttacttatctgtgtattcacagagcttagcacagtgcctggtaatgagcaagcatacttgccattacttttccttcccactctctccaacatcacattcactttaaatttttctgtatatagaaaggaaaactagcctgggcaacatgatgaaaccccatctccactgcaaaaaaaaaaaaaaaaaataagaaagaacaaaacaaaccccacaaaaattagctgggtatgatggcacgtgcctgtagtcccagttactcaggatgattgattgagccttggaggtggaggctacagtgagctgagattgtgccactgtactctagccagggagaaagagtgagatcctggctcaaaaaaaccaaataaaacaaaacaaacaaacgaaaaacagaaaggaagactgaaagagaatgaaaagctggggagaggaaataaaaataaagaaggaagagtgtttcatttatatctgaatgaaaatatgaatgactctaagtaattgaattaattaaaatgagccaacttttttttaacaatttacattttatttctatgggaaaaaataaatattcctcttctaacaaacccatgcttgattttcattaattgaattccaaatcatcctagccatgtgtccttccatttaggttactggggcaaatcagtaagaaagttcttatatttatgctccaaataattctgaagtcctcttactagctgtgaaagctagtactattaagaaagaaaacaaaattcccaaaagatagctttcacttttttttttccttaaagacttcctaattctcttctccaaattcttagtcttcttcaaaataatatgctttggttcaatagttatccacattctgacagtctaatttagttttaatcagaattatactcatcttttgggtagtcatagatattaagaaagcaagagtttcttatgtccagttatggaatatttcctaaagcaaggctgcaggtgaagttgtgctcaagtgaatgttcaggagacacaattcagtggaagaaattaagtctttaaaaaagacctaggaataggagaaccatggaaattgaggaggtaggcctacaagtagatattgggaacaaaattagagaggcaaccagaaaaagttattttaggctcaccagagttgttcttattgcacagtaacacaccaatataccaaaacagcaggtattgcagtagagaaagagtttaataattgaatggcagaaaaatgaggaaggttgaggaaacctcaaatctacctccctgctgagtctaagtttaggatttttaagagaaaggcaggtaaggtgctgaaggtctggagctgctgatttgttggggtatagggaatgaaatgaaacatacagagatgaaaactggaagtttttttttgtttgttttgttttttttttgttgttgtttttttttttttttgtttttttgctgagtcaattccttggagggggtcttcagactgactggtgtcagcagacccatgggattccaagatctggaaaactttttagatagaaacttgatgtttcttaacgttacatatattatcttatagaaataactaagggaagttagtgccttgtgaccacatctatgtgacttttaggcagtaagaaactataaggaaaggagctaacagtcatgctgtaagtagctacagggaattggcttaaagggcaagttggttagtacttagctgtgtttttattcaaagtctacattttatgtagtggttaatgtttgctgttcattaggatggtttcacagttaccatacaaatgtagaagcaacaggtccaaaaagtagggcatgattttctccatgtaatccagggagaaaacaagccatgaccattgttggttgggagactgaaggtgattgaaggttcaccatcatcctcaccaacttttgggccataattcacccaaccctttggtggagcctgaaaaaaatctgggcagaatgtaggacttctttattttgtttaaaggggtaacacagagtgcccttatgaaggagttggagatcctgcaaggaagagaaggagtgaaggagagatcaagagagagaaacaatgaggaacatttcatttgacccaacatcctttaggagcataaatgttgacactaagttatcccttttgtgctaaaatggacagtattggcaaaatgataccacaacttcttattctctggctctatattgctttggaaacacttaaacatcaaatggagttaaatacatatttgaaatttaggttaggaaatattggtgaggaggcctcaaaaagggggaaacatcttttgtctgggaggatattttccattttgtggatttccctgatctttttctaccaccctgaggggtggtgggaattatcattttgctacattttagaggtcatccaggatttttgaaactttacattctttacggttaagcaagatgtacagctcagtcaaagacactaaattcttcttagaaaaatagtgctaaggagtatagcagatgacctatatgtgtgttggctgggagaatatcatcttaaagtgagagtgatgttgtggagacagttgaaatgtcaatgctagagcctctgtggtgtgaatgggcacgttaggttgttgcattagaaagtgactgtttctgacagaaatttgtagctttgtgcaaactcacccaccatctacctcaataaaatatagagaaaagaaaaatagagcagtttgagttctatgaggtatgcaggcccagagagacataagtatgttcctttagtcttgcttcctgtgtgccacactgcccctccacaaccatagctgggggcaattgtttaaagtcattttgttcccgactagctgccttgcacattatcttcattttcctggaatttgatacagagagcaatttatagccaattgatagcttatgctgtttcaatgtaaattcgtggtaaataacttaggaactgcctcttctttttctttgaaaacctacttataactgttgctaataagaatgtgtattgttcaggacaacttgtctccatacagttgggttgtaaccctcatgcttggcccaaataaactctctacttatatcagtttttcctacacttcttccttttaggtcaacaataccaagaggggttactgtgctgggtaatgtgtaaacttgtgtcttgtttagaaagataaatttaaagactatcacattgctttttcataaaacaagacaggtctacaattaatttattttgacgcaaattgataggggggccaagtaagccccatatgcttaatgatcagctgatgaataatcatctcctagcaacataactcaatctaatgctaaggtacccacaagatggcaaggctgatcaaagtcgtcatggaatcctgcaaccaaaagccatgggaatttggaagccctcaaatcccattcctaatctgatgagtctatggaccaatttgtggaggacagtagattaaatagatctgatttttgccatcaatgtaaggaggataaaaacttgcataccaattgtacacccttgcaaaatctttctctgatgttggagaaaatgggccagtgagatcatggatatagaagtacagtcaatgttcagctgtaccctcccacaatcccacttccttcctcaacacaattcaaacaaatagactcagactgtttcaggctccaggacaggaagtgcagtgtaggcaaaattgcaaaaattgagggcacaggggtggaggtgggggggttgaataacaagctgtgctaaataattacgtgtaaatatattttttcatttttaaaaattgatttcttttgcacattccatgacaatatatgtcacatttttaaaataaatgcaaagaagcatacatccaa

SEQ ID NO: 129 - DNA, 7077 bp, Homo sapiens
agtgagtgacacggcgagcgtgagccgcggccccagccgggccgagcgcgctgcctgagctgagccgccgtaggtgaggggcccgcgtccccgcccgccctgggcgccgcgcctggcactgatcctgccggtcgcccactgtcgccgccgccgccgcccgcgggcaccatgacagctctgagcgctggggttacagactgtggttttgtgcttgctcaccaaagctaacctcagcatgctcaaaaggaagcagagttccagggtggaagcccagccagtcactgactttggtcctgatgagtctctgtcggataatgctgacatcctctggattaacaaaccatgggttcactctttgctgcgcatctgtgccatcatcagcgtcatttctgtttgtatgaatacgccaatgaccttcgagcactatcctccacttcagtatgtgaccttcactttggatacattattgatgtttctctacacggcagagatgatagcaaaaatgcacatccggggcattgtcaagggggatagttcctatgtgaaagatcgctggtgtgtttttgatggatttatggtcttttgcctttgggtttctttggtgctacaggtgtttgaaattgctgatatagttgatcagatgtcaccttggggcatgttgcggattccacggccactgattatgatccgagcattccggatttatttccgatttgaactgccaaggaccagaattacaaatattttaaagcgatcgggagaacaaatatggagtgtttccatttttctacttttctttctacttctttatggaattttaggagttcagatgtttggaacatttacttatcactgtgttgtaaatgacacaaagccagggaatgtaacctggaatagtttagctattccagacacacactgctcaccagagctagaagaaggctaccagtgcccacctggatttaaatgcatggaccttgaagatctgggacttagcaggcaagagctgggctacagtggctttaatgagataggaactagtatattcaccgtctatgaggccgcctcacaggaaggctgggtgttcctcatgtacagagcaattgacagctttccccgttggcgttcctacttctatttcatcactctcattttcttcctcgcctggcttgtgaagaacgtgtttattgctgttatcattgaaacatttgcagaaatcagagtacagtttcaacaaatgtggggatcgagaagcagcactacctcaacagccaccacccagatgtttcatgaagatgctgctggaggttggcagctggtagctgtggatgtcaacaagccccagggacgcgccccagcctgcctccagaaaatgatgcggtcatccgttttccacatgttcatcctgagcatggtgaccgtggacgtgatcgtggcggctagcaactactacaaaggagaaaacttcaggaggcagtacgacgagttctacctggcggaggtggcttttacagtactttttgatttggaagcacttctgaagatatggtgtttgggatttactggatatattagctcatctctccacaaattcgaactactactcgtaattggaactactcttcatgtatacccagatctttatcattcacaattcacgtactttcaggttctccgagtagttcggctgattaagatttcacctgcattagaagactttgtgtacaagatatttggtcctggaaaaaagcttgggagtttggttgtatttactgccagcctcttgattgttatgtcagcaattagtttgcagatgttctgctttgtcgaagaactggacagatttactacgtttccgagggcatttatgtccatgttccagatcctcacccaggaaggatgggtggacgtaatggaccaaactctaaatgctgtgggacatatgtgggcacccgtggttgccatctatttcattctctatcatctttttgccactctgatcctcctgagtttgtttgttgctgttattttggacaacttagaacttgatgaagacctaaagaagcttaaacaattaaagcaaagtgaagcaaatgcggacaccaaagaaaagctccctttacgcctgcgaatctttgaaaaatttccaaacagacctcaaatggtgaaaatctcaaagcttccttcagattttacagttcctaaaatcagggagagttttatgaagcagtttattgaccgccagcaacaggacacatgttgcctcctgagaagcctcccgaccacctcttcctcctcctgcgaccactccaaacgctcagcaattgaggacaacaaatacatcgaccaaaaacttcgcaagtctgttttcagcatcagggcaaggaaccttctggaaaaggagaccgcagtcactaaaatcttaagcaagaggccattaccgacgagctcacccattagcatccgctgttgtctctacttgggaagatcacattgtcactctagtggagtcagagcttgcacccgacagcgcatgctgagcggatcatttgaggggcagcccgcaaaggagaggtcaatcctcagcgtgcagcatcatatccgccaagagcgcaggtcactaagacatggatcaaacagccagaggatcagcaggggaaaatctcttgaaactttgactcaagatcattccaatacagtgagatatagaaatgcacaaagagaagacagtgaaataaagatgattcaggaaaaaaaggagcaagcagagatgaaaaggaaagtgcaagaagaggaactcagagagaaccacccatacttcgataagccactgttcattgtcgggcgagaacacaggttcagaaacttttgccgggtggtggtccgagcacgcttcaacgcatctaaaacagaccctgtcacaggagctgtgaaaaatacaaagtaccatcaactttatgatttgctgggattggtcacttacctggactgggtcatgatcatcgtaaccatctgctcttgcatttccatgatgtttgagtccccgtttcgaagagtcatgcatgcacctactttgcagattgctgagtatgtgtttgtgatattcatgagcattgagcttaatctgaagattatggcagatggcttatttttcactccaactgctgtcatcagggacttcggtggagtaatggacatatttatatatcttgtgagcttgatatttctttgttggatgcctcaaaatgtacctgctgaatcgggagctcagcttctaatggtccttcggtgcctgagacctctgcgcatattcaaactggtgccccagatgaggaaagttgttcgagaacttttcagcggcttcaaggaaatttttttggtctccattcttttgctgacattaatgctcgtttttgcaagctttggagttcagctttttgctggaaaactggccaagtgcaatgatcccaacattattagaagggaagattgcaatggcatattcagaattaatgtcagtgtgtcaaagaacttaaatttaaaattgaggcctggagagaaaaaacctggattttgggtgccccgtgtttgggcgaatcctcggaactttaatttcgacaatgtgggaaacgctatgctggcgttgtttgaagttctctccttgaaaggctgggtggaagtgagagatgttattattcatcgtgtggggccgatccatggaatctatattcatgtttttgtattcctgggttgcatgattggactgaccctttttgttggagtagttattgctaatttcaatgaaaacaaggggacggctttgctgaccgtcgatcagagaagatgggaagacctgaagagccgactgaagatcgcacagcctcttcatcttccgcctcgcccggataatgatggttttagagctaaaatgtatgacataacccagcatccattttttaagaggacaatcgcattactcgtcctggcccagtcggtgttgctctctgtcaagtgggacgtcgaggacccggtgaccgtacctttggcaacaatgtcagttgttttcaccttcatctttgttctggaggttaccatgaagatcatagcaatgtcgcctgctggcttctggcaaagcagaagaaaccgatacgatctcctggtgacgtcgcttggcgttgtatgggtggtgcttcactttgccctcctgaatgcatatacttacatgatgggcgcttgtgtgattgtatttaggtttttctccatctgtggaaaacatgtaacgctaaagatgctcctcttgacagtggtcgtcagcatgtacaagagcttctttatcatagtaggcatgtttctcttgctgctgtgttacgcttttgctggagttgttttatttggtactgtgaaatatggggagaatattaacaggcatgcaaatttttcttcggctggaaaagctattaccgtactgttccgaattgtcacaggtgaagactggaacaagattatgcatgactgtatggttcagcctccgttttgtactccagatgaatttacatactgggcaacagactgtggaaattatgctggggcacttatgtatttctgttcattttatgtcatcattgcctacatcatgctaaatctgcttgtagccataattgtggagaatttctccttgttttattccactgaggaggaccagcttttaagttacaatgatcttcgccactttcaaataatatggaacatggtggatgataaaagagagggggtgatccccacgttccgcgtcaagttcctgctgcggctactgcgtgggaggctggaggtggacctggacaaggacaagctcctgtttaagcacatgtgctacgaaatggagaggctccacaatggcggcgacgtcaccttccatgatgtcctgagcatgctttcataccggtccgtggacatccggaagagcttgcagctggaggaactcctggcgagggagcagctggagtacaccatagaggaggaggtggccaagcagaccatccgcatgtggctcaagaagtgcctgaagcgcatcagagctaaacagcagcagtcgtgcagtatcatccacagcctgagagagagtcagcagcaagagctgagccggtttctgaacccgcccagcatcgagaccacccagcccagtgaggacacgaatgccaacagtcaggacaacagcatgcaacctgagacaagcagccagcagcagctcctgagccccacgctgtcggatcgaggaggaagtcggcaagatgcagccgacgcagggaaaccccagaggaaatttgggcagtggcgtctgccctcagccccaaaaccaataagccattcagtgtcctcagtcaacttacggtttggaggaaggacaaccatgaaatctgtcgtgtgcaaaatgaaccccatgactgacgcggcttcctgcggttctgaagttaagaagtggtggacccggcagctgactgtggagagcgacgaaagtggggatgaccttctggatatttaggtggatgtcaatgtagatgaatttctagtggtggaaaccgttttctaataatgtccttgattgtccagtgagcaatctgtaattgatctataactgaattccagcttgtcacaagatgtttataaattgattttcatcctgccacagaaaggcataagctgcatgtatgatgggttactatcaatcattgctcaaaaaaatttttgtataatgacagtactgataatattagaaatgataccgcaagcaaatgtatatcacttaaaaatgtcatatattctgtctgcgtaaactaaggtatatattcatatgtgctctaatgcagtattatcaccgccccgcaaaagagtgctaagcccaaagtggctgatatttagggtacaggggttatagctttagttcacatctttcccatttccactagaaatatttctcttgagagaatttattatttatgattgatctgaaaaggtcagcactgaacttatgctaaaatgatagtagttttacaaactacagattctgaattttaaaaagtatcttctttttctcgtgttatatttttaaatatacacaagacatttggtgaccagaacaagttgatttctgtcctcagttatgttaatgaaactgttgcctccttctaagaaaattgtgtgtgcaagcaccaggcaaagaaatggactcaggatgcttagcggtttaaaacaaacctgtagataaatcacttgagtgacatagttgcgcaaagatgttaagtttcttaagaaaccttttaataactgagtttagcaaaaagaataaaactatatagctcaatttatttaaaaaaatctttgcatgtgtgatgttatcattggcttcatttcttacccaaggtatgtctgttttgccataaatcagcagagtcatttcattctgggtgatcctaacacaccattgctacgttagatttgaaatgacatctctgttaaaagaatcttctatggaaataatggtgccctgcaaaatcttcctttgaactcacaggttagggatcacacaacttacttaatcgttttttgtttttgttttttttccttatatgtcaatggcccatgtcctccgggaaaattagaaaagcaaaatgattacaaagtgctgttagatttcttgtgctgggccagccaagtagaagtggacttgacttggacctttaactattttattacagattggacatttgctgttcagatgttttttaacagagggattatctcagaatcctgtgacctccaggttgttttataatctatttttctctatttaacattcctcagatagataggcaaataggacattccttctgtgtcacagaagtatcgtggtagtggcagtctacagtttatatgattcattgtaactatgagataaagaacaaccagtcatgtggccaaaaggattagatttgatttgatgttcacttggagtttactttttgtacatacaagataaaataaatattggatttgtaaaataattaaaaaaaaaaaaaaaaa

SEQ ID NO: 130 - DNA, 8804 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaagta

SEQ ID NO: 131 - DNA, 2197 bp, Homo sapiens
agtgtgtgcggaacgcaagcagccgagagcggagaggcgccgctgtagttaactcctccctgcccgccgcgccgaccctccccaggaacccccagggagccagcatgaagcgagctcaccccgagtacagctcctcggacagcgagctggacgagaccatcgaggtggagaaggagagtgcggacgagaatggaaacttgagttcggctctaggttccatgtccccaactacatcttcccagattttggccagaaaaagacggagaggaataattgagaagcgccgacgagaccggatcaataacagtttgtctgagctgagaaggctggtacccagtgcttttgagaagcagggatctgctaagctagaaaaagccgagatcctgcagatgaccgtggatcacctgaaaatgctgcatacggcaggagggaaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttatcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatccaagaaagaagactagtaaattgtctgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaaactgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaagaaagaacaaagta

SEQ ID NO: 132 - DNA, 4330 bp, Homo sapiens
agaggccgaggaagccggttccggggacgggcaacagggactcagggaccagaaggcggctgcaggacgcgaccgagcaggaccccaggcccgggaacgacgtcgcgagcgctgagactgccgggcctcccagcccatctggcattcgagcgcaggaccgggcgccccggcaccgccgcgcgccacccgctaggatgccggtggccccagcgccctcagccgacggaggagccctttttcaacgccctcgctggagtctggcctgcacgccttgctgaatgaagccggaacctcagccccgcttccctttgaaatgaatgttcctggggcgccctctcgtggattttggagctaatcgtctgtgaatgccaagtgatggcaactgccctcccgccgcgtctccagccggtgcgggggaacgagaccctgcgggagcattaccagtacgtggggaagttggcgggcaggctgaaggaggcctccgagggcagcacgctcaccaccgtgctcttcttggtcatctgcagcttcatcgtcttggagaacctgatggttttgattgccatctggaaaaacaataaatttcacaaccgcatgtactttttcattggcaacctggctctctgcgacctgctggccggcatcgcttacaaggtcaacattctgatgtctggcaagaagacgttcagcctgtctcccacggtctggttcctcagggagggcagtatgttcgtggcccttggggcgtccacctgcagcttactggccatcgccatcgagcggcacttgacaatgatcaaaatgaggccttacgacgccaacaagaggcaccgcgtcttcctcctgatcgggatgtgctggctcattgccttcacgctgggcgccctgcccattctgggctggaactgcctgcacaatctccctgactgctctaccatcctgcccctctactccaagaagtacattgccttctgcatcagcatcttcacggccatcctggtgaccatcgtgatcctctacgcacgcatctacttcctggtgaagtccagcagccgtaaggtggccaaccacaacaactcggagcggtccatggcactgctgcggaccgtggtgattgtggtgagcgtgttcatcgcctgctggtccccactcttcatcctcttcctcattgatgtggcctgcagggtgcaggcgtgccccatcctcttcaaggctcagtggttcatcgtgttggctgtgctcaactccgccatgaacccggtcatctacacgctggccagcaaggagatgcggcgggccttcttccgtctggtctgcaactgcctggtcaggggacggggggcccgcgcctcacccatccagcctgcgctcgacccaagcagaagtaaatcaagcagcagcaacaatagcagccactctccgaaggtcaaggaagacctgccccacacagccccctcatcctgcatcatggacaagaacgcagcacttcagaatgggatcttctgcaactgatcgtctccatgcgccctgctctgcggctgtgttcttatttattgcatgcgtcgcttccacaggggcccctcaagagctgtgactcgggagagctaccttactttgaccaacagcctgcccagtgtggatgtctcttacagagggggcccaaggaatcaccaccccgcttcagtgtaaacaacgtgccttgtccactttgggctccagagtctttcagatgtactaagctgctgacatcatccactgccttctgctgcatcctagacaccctccctgttgttcacagagagggaaggtcgtgggccacacaatgctgtgtgaccctctccgtgtgcctctgaatggtgttttgatgattttacactacatttcctgtgcgtagaatggatgcttgtatattcgtacatctctatgttacacagaatttgtgttgcaggtgtttgccatgtggtacctacatagaatctccatacaacacacaggtaacaggttatacaagtggattcagactgaacccccagtacaaggacattgttttgaactaggtggacatgccatccctggtctccttagactgacatgattctcatgttaaccaagttttaaaagttcaaattccccaaaaaggcttgtccaaggctggccccagatgtgtgggtctgacccacaccagccctgtgtcctgtcctttcagtcatttgtccctgcgtaattttaatcgtattccaaagcccaattatgtgatggttttcaggtttctgcaaattacagaagagccagccaagatcacccaggagcttgtgcccccagatgggccaaagaaagagcctatgaaggagaagcagaagcagacggctggcctggctcaccttcccacgccagtggggcaggggtctgcttcaggaaatggaagctgtccaggaaatgagcagagattcacaagacagcactttgattctatgttgagtttgtttctatattagaaaagcagcaagtcagtaatcccccgtggcatcacagctaagtagctgtggccaccggcagtttcacagcatcctgaaagctggcactgatcgtgactatcagtgaaagaagtttaattttcaggttagaaaatgtgatctggcagtttatgcattcttcagagtaatgtaataatacctatgtgatgctgtaattttacttttcaacataagttgaacccgtagcagtctgtttaccttgtaaagggattacttagaagacatttttgtacatgctcttccccaaggattgtacgtattatacaaatagatggaaagaaaagtgaacacgtttgtagaactttcataagcacacagttgctgtgttgagttctctttaaaaacaaggacaaaaccaaccagcgttcaaaggaacctcccatcagagtcccctaaagtattttaggttcagtgagcatttgcctgaataaaacctaaaagagtagtcttaacacattactaactttttctaagagaaattgattcctgttttgtcatctgatgcaatttgctcttataaagagacattttcataggttcagagtaactcacctccatgggctgaccaaaggcttttctaatttttgttactgatgagatgaaacctatttgtaaggagatcttccccaggagcatttctgttgccttcttgacatcaatgaaaagtagcatattctcttatgaaatagcatgagaaaacacagggcatttctaggacagtaaaacgttaaagtactggattaagaaaacaacaacaggctgggcgcagtggctcacacctgtaatcccagcactttgggaggctgaggcgggtggatcacctgaggtcaggagtttgtgaccagcctggccaacatagtgaaatcctgtttctactaaaaatacaaaaattagctggatgcgatagcacgtgcctgtagtcccagctactcgggaggctgaggctggagagttgctcaaacccgggaggcggagattgcagtgagccaagatcgcaccgctgcactccagcctgggtgacagagcgaccctctgtctcaaaaaataataataataataaataaaacaacaacaaaatgcatcagagagccaaaacattcagtattgcattttcacataggtgatgaaatgactttggaactttatctgtgttatagttatgagttgctttgggagacttggagctctctgtagctattgttcataacactttgctccataaccctgatgtccgcagtatctaagtatctcagccttcatccattaactctactagggagcccacagccaccatttccactaggaggtatcaatatttgtggtatgacataaggctcccttgaaataacaagacttttgagcaatctgaattaaaaatacatcaaaaaagtaatagcgctcatttgctaaatgcaaaaaataatcacctttgataccaatgtgcaccaatatgcctaactagctagccagctggagataatttaccagggaatgtttcaaagccctaaccttgaagtttggaaacaggtggtcttctatgctgcagagaaactatgcattaggtctcttttcaattagaaacctttactatttccaatgtatgtttgttaaaaataataataataaaaccaaaagcctttgtggaaacccactcttcgtagtccatgtgatgggattgttttatcgttttcaccgggtgccctccccactgcaggggtgcgcactgttgttgcaggcttgctacccacctgtgtttcttagcatttcaggaattaaaccacattcagaaccccaaa

SEQ ID NO: 133 - DNA, 2278 bp, Homo sapiens
ctctgccctttctgagcccgagggactgccacctccactgtgtgcacactcagctacgggacacatttcaggtatccaaggcagcagaggtgagtgggtcccccgagctctgtgaccttatgctccacactaactctggcagagcctccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctaagctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaatgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactg

SEQ ID NO: 134 - DNA, 3664 bp, Homo sapiens
cttcctggttcctgcagcagctgctgccactgctcagcgcggtgaggagggagccggtgactcggagacggtgactcagaggcagagcggcgcaagggccaaggagtactggcgtccatggaccctggggaccccgtcaggagcaggtgacatccttccccttccaccctgctccctgctctacatccccagcagggagtggcctctcccttctccatggacttccaagagagggacccgcccttcctgcctgagagcgctcagtcctcaaagcccagcagtgctcagcaggcctctgagctgtgggaggtggtggaggagcctcgggtcaggctggggacagagggtgtcatgcctgagaggcaggaaggtcacctgctcaagaagaggaagtggcctctgaagggctggcacaagagatactttgtgctcgaggacgggatccttcattatgcaacaacccggcaagacatcaccaaggggaagctccatggctccatcgatgtccggctgtcggtcatgtccatcaacaaaaaggcccagcgcattgaccttgacactgaagacaacatctaccacctcaagatcaaatcccaggacctattccagagctgggtggcgcagctgcgtgcccaccgcctagcccaccgcctggacatgccccgtggctcactgcccagtactgctcaccggaaggttcctggtgcccagcttccaacagcagctactgcctcagccctacctgggcttggaccgcgggagaaagtgtcttcctggctgagggacagtgatgggctggaccgctgctctcatgagctctctgagtgtcaggggaagctccaggaactacacaggctcctccagagcctggagtccctgcaccgaatcccctcagcccctgttatccccacacaccaggcctcagtgacaaccgaaagacccaagaaggggaaacggacaagccgcatgtggtgcacccagagctttgccaaggatgacaccattggacgggttggtcgtctccatggctctgttcccaacctgtctcgctacctggagtctcgggactcctcgggcacccgtgggctgccacccacagactatgcccacctgcagcgcagcttctgggccctggcccagaaggtgcacagctccctcagcagcgtcctggccgccctcaccatggaacgggaccaactgagggacatgcaccagggctcagagttgtcaagaatgggggtctctgaggcctccactggccagaggcgcctccactcactgtccacctcctccgacaccacggcggactctttcagctccctcaaccctgaggagcaagaagctctgtacatgaaggggcgcgagctcaccccccagctatcgcagaccagcatcctgtcccttgctgattcccacacggagttcttcgatgcctgcgaggttctcctctccgccagctcttctgagaatgagggctcagaggaggaggagtcctgtaccagtgaaatcaccaccagcctgtctgaggagatgctggacctcaggggagctgagcgctgtcagaaaggggggtgtgttccagggagacccatggggccaccccgccgtcgctgcctgccggcggccagcgggcctggggctgacgtgagcctgtggaacattctgcgcaacaacatcggcaaagacctgtccaaggtgtcaatgcctgtgcagctcaacgagccgctcaacactctgcagcggctctgcgaggagctggagtacagcagcctcctggaccaggccagccgcatcgccgacccctgcgagcgcatggtgtacatcgcagcctttgctgtctcggcctactcctccacataccaccgagccggctgcaagcccttcaaccctgtcctgggggagacctacgagtgtgagcggcctgaccgaggcttccgcttcatcagtgagcaggtctcccaccacccccctatctcggcctgccatgcagagtctgagaacttcgccttctggcaagatatgaagtggaagaacaagttctggggcaaatccctggagattgtgcctgtgggaacagtcaacgtcagcctgcccaggtttggggaccactttgagtggaacaaggtgacatcctgcattcacaatgtcctgagtggtcagcgctggatcgagcactatggggaggtgctcatccgaaacacacaggacagctcctgccactgcaagatcaccttctgcaaggccaagtactggagttccaatgtccacgaggtgcagggcgctgtgctcagtcggagtggccgtgtcctccaccgactctttgggaagtggcacgaggggctgtaccggggacccacgccaggtggccagtgcatctggaaacccaactcaatgccccccgaccatgagcgaaacttcggcttcacccagtttgccttggagctgaatgagctgacagcagagctgaaacggtcgctgccttccaccgacacgagactccggccagaccagaggtacctggaggaggggaacatacaggccgctgaggcccagaagagaaggatcgagcagctgcagcgagacaggcgcaaagtcatggaggaaaacaacatcgtacaccaggctcgcttcttcaggcggcagacggatagcagcgggaaagagtggtgggtgaccaacaatacctactggaggctgcgggccgagccaggctatgggaacatggatggggccgtgctctggtagccctggccccgggggcaggaggctctggttcctcactcctcctgcctccaccccctaccatggacacatgggtgaggccgggctccccgcctcactgcccttgagaccaaaggggcagccctggccctccctcccctctgctggccagagggtctgcatctcagcccacccccaaccccaccgtttggggtgagaagcagaatctgtgcttccccagtctccttgccccagacaaccagcatgtaagacccttcccgcttcaccattccgattcctgtcccctttggggtacttgggggagactctggctcccaggatctgttccctatttcagtgccttcctaggacacaggggactccttgacgctccccaggctttctgtgcccaggcctctgtccccagcggtgaggttgcagtgagtgaaggagaggaggtgatctgttctccctccccttctgcccatctccagcatcttcttccccttccctggccctgcagggccttctccagctccctttggttagtccctggccatccctcctgtcctggatcccttctccctaactgcaaaatgcctgcagcttccagctccttcgtccctgatcctcaagcggttccctcccgtctcagctcagcggatcccccagagtggaggaggcctctccatgaggaggggagcagcccaaggcacctgtcctctgacccaccggcagcgagtgcgcaggtgtgagtgtaagttcatgtaggagagtgtatgcgtgtgcgcctgtgccctgcttgcaggcaagcagggctccctcatgtagccccgccttccccctgctgggggtccaccacatcgctgctctttctcacagtctgcctctgatgagggcgaattgctatgacattccaagctccaataaagactgtcccaga

SEQ ID NO: 135 - DNA, 1922 bp, Homo sapiens
cttatctgatgctgtgcattagacagcacactgctgactgttttcagttgtttctgtaacagcagaaagtgcactcactaggagtagtcagaattcaaaatgctcaagagaaagccatccaatgtttcagagaaggagaaacatcaaaaaccaaagcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgcatattgcaaaaaaaaaaaaaaaaaa

SEQ ID NO: 136 - DNA, 513 bp, Homo sapiens
attcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttt

SEQ ID NO: 137 - DNA, 5614 bp, Homo sapiens
atgctgctcggagcgtcctggctgtgcgcatccaaggcggccgccgctgctgcgcagagcgagggcgacgaggacaggccaggcgagcgacggcggcgtcgggcggcggccaccgccgcgggggcgggcgaggacatggacgagtcgtcgctgctggacctgctggagtgctccgtgtgtctggagcgcctggacaccacggccaaggtgctgccatgccaacacactttctgccgccgctgcctggagagcatcgtgtgctcgcgccacgagctgcgctgccccgagtgccgcatcctggtgggctgcggcgtggacgaactgcccgccaacatcttgctggtgcgactgctggacggcatccgtcagcggccccgcgcgggcaccagccccggcggcagcccgcccgcgcgtcccatcccaggccagagtgcggcccccacgctcgcgggcggcgggggcggcgcggcaggcagcaccccgggttccccggttttcctctccgcggccgcgggcagcaccgccggcagtctgcgggagctggcgaccagcaggaccgcgccggcggcaaagaatccctgcctgcttccctatggcaaggccctctacagctacgaggggaaggaacctggtgacctcaagttcaacaagggggacatcatcgtcctgcggcgcaaggtggatgaacagtggtaccacggcgagctgcacggcacacagggcttcctcccagccagctatatccagtgcatccagcccttgccacacgccccgccccagggaaaagcactttatgatttcgagatgaaggacaaagaccaagacaaggactgtctgaccttcaccaaggacgagattctgacggtgctcaggagagtggatgagaactgggcggaaggcatgctgggagacaagatcgggatcttcccgctcctgtacgtggagctcaatgactccgccaagcagctcattgagatggacaagccatgcccagccgctgcatccagctgcaatgcctccctgccctctgactccggcgctgtggccagcgtggccccaagtcccactttaagcagctcaggggcggtcagtgcctttcagcggcgtgtggatggcaagaagaacaccaagaaacgccactccttcaccgcgctcagtgtgacgcacagatcctcccaggctgccagccacaggcattccatggaaattagtgctccagtgttgatcagctccagcgatccccgagccgcggccaggattggagaccttgctcatctgtcgtgcgctgctcccacccaggatgtctcctcctcggcgggatctacccccacggctgtcccacgggctgcctcggtgtctggagagcagggcacgcctcccaaggtccagctgcccctcaacgtgtacctggcgctctacgcctacaagccccagaagagtgacgagctggagctgcacaagggagagatgtaccgggtcctcgagaagtgtcaggatggctggttcaagggggcgtctctgaggaccggggtctctggggtgttccccggaaactacgtgacacccgtttccagggtgcctgcaggaggggcagggccgccccggaataatgtagtcggagggtctccactggccaaagggataaccacaaccatgcacccaggcagtgggagtctgagcagcctggccactgccaccaggcccgccctgcccatcaccactccccaggcccacgcccagcaccccacagcctcgcccccaacaggcagctgtctacggcactcagcccagccaacggccagccaagcccggagcaccatttcaacagctgcccactctgcagcccaggctcaggaccggccaactgccaccgtgtcacccctgcgcacccagaactctccatcccgcctgcctgccaccagcctcaggccccactcggtggtgtccccgcagcacagccaccagcccccggtgcagatgtgcccacggccggccatccccctcacatcagcagcatcagccatcacacctcccaacgtcagtgccgcaaacctcaacggggaggctggaggggggcccatcggtgttctgtccacatccagccccaccaacacgggatgcaaactagacgagaagaaaagtgaaaagaaagagaagaagagtgggctcctgaagcttctagccggagcatccaccaagaagaagtcacgctccccgccatctgtgtctccaacccacgacccccaggtggccgtggacgccctgctccaaggtgcagtgggccccgaagtgtcctcactgtccatccacggcagggcagggtcctgccccatagagagcgagatgcagggtgccatggggatggagcctctgcacaggaaggcaggctccttggatctaaacttcacatctccttcccggcaagctccgctgtccatggctgccatccgccccgagcccaagctgttgcccagagagaggtaccgcgtggtggtctcgtacccaccccagagtgaggcggagatcgagctgaaggaaggcgacatcgtctttgtgcacaagaagcgtgaggacggctggtacaaggggaccctgcagcggaacggccgcacaggcctcttcccgggcagcttcgtcgagagcttctgagaactggtgctccctgcacccagctcacagagggggaggccgcctgggaagctccacggcacacagagagggagccatggcgccccaagggttccaggtcatctccaaggcacctggcgggggataccctggcccagggtgggggccagggactgtggaggtcgtgccttctcccaaaacccccaaacggagagcacacctgggatgttcttcaaggaaatgcccaccccctctgtggaaactgcaaagaaagcaccttgaggaagagaggcaggtgccggcgcaggcaggcctgtggctgtggtttgcagccatggcagcgttctcatttaccacctaagcagggttggaggttgcaggaggtctgcaggcgaggtgggtggcatgggggccaggagcgctggagatcatctttctgggctgccctgggcttcccgcggggcccaggttgctctgtcaccattctatatacctcagtcacctgccgcccggctgctcagcaggggtgtttgtgaggccctgggggtgccccggaaggggcaccccaccgcccctgttgggaaccagagcagaatctgtgggcttgtcgcctgccagtagtataagcaacactttctgttcaccaccattgtcccttgcattacttctttcttacagcatatttttaacataaagctgttagactttatatatttctaataggtcagacattgcctatttttcatacatctggtgctgcctttttgtaaaactaataatgacttggttgagcttgaaagaaaagatgtctgaggcgacatcaaaggggcagaatttttatatttcccatatggctttgggagagcgccgagaagccgccatcccgcacctcagcgctggccagtactctgggggctggcggggtggatccattgagggggtcggagggagcttggaagcagccggtttctttaaactcttaccaaaaccccgcgctctgtctagacggtgatgattattattcaagacctggaaacatttcgaggaagggccactataattgtccttttgtgtggcggtagaaggagcacgcaggtcaaccccagccgggaaggcaaaatcttccctttattgcctcagagagaactgcaattagcattctcagaagatgatttcttggtatcaaaatgtgcagtttctacaacagtttagatcaccaccaccatttttcttcttttttaaaaataaataactgctcccatttcaggcagtgcaaaccttcatctgctggagaccagaggtacaaggagatcagggggttgcagcaccgctgcaggcttgcaagatcggggagttgggagggcgagagaggaggaggtgcagctttgatgctgggacctccctgagtggggctgatgaatgtatattcattagcaccatggctcacttcccaggaagactgatcaggagcccttcagggacaattttgttctcaagattcacaccttaggaacacatttttatcacctcaaaattttgatccatcacccctctctccacctatatttttacaaataccattcagacttaaattaagctgaagaaactagcctttggtaacatagggtgtcattggttttcagggatgtaaccaattccagaaatacattcttttgcctggcatgaagactttgaaacacgggccgcttattttcagagttcctgttttgggacgtgacttggctacttgttacttccaggtggtcaccacacggcgggggtcatgcctttccctcccccaagatgataatagatttaatagactcaaagaagttgttcagaatcaaagaagaaaaagtctggcttaaacatagtaacttctgtgtgccaggttaatgacaaccaaaagctctctatttaccattattgccaaacttcatcagttgcccatcctgcaccaaaatcctgtgcgtgtttaaattcacgttgtcaccaaagaggtgcacagatcaacaacctggatgacgcaggtgttctccagggaaaccagaccaagtcaagtctccaggtaacttttttgaagtcttttttttaaggcgcgcaggtaccaagcaacagaatagagtaacctgaacgttcttactctcccaggcatggcccacgtggtgcttcaggtagaaatgtgcttcaccctcctggtggggggcgaggacacagcccactgcatgcagcatggtagagagctggggcgaatatctccatgtctttggaggatgtcagctggccgctttcagggcagagtcgggtgggcgttggtgccaccttaggaaggagagcgatgcgtgggtctggccagagctctggagccaatgccgggctgcctgagagcagaggaaatgcatggcccatgtgcatttctgagtattttaaactcgttcaggccctgcagccttcatgatgatgtagctcgcagagaagagcaggagcagaattagccctttcttcaggccatcttgcctcaaagggtacacatgtttggcggttaagatgaaactaacccttatgtttcatcctggccccatgatgtacacatcttagccatgtagtggccttggggggccacagagatttcctttgaggagcatggtagagtccacagccatggctgaagtcagtggacaccgaggggacaggactgcaggccaccaggggcctctgcccagagggaggcagagaggatggcggccacgggtgctctcctggcatcctcatggggtgatgccaggccgggcacttcaaaacaggctcagccgactgggagatcctttgtactttgcacagttcacacacacaaacacacacaccctatcccaagtgtttttgttagacacaaatgtcagcgtgtgattttggaagacttgtcagtgatgacaaaccatgatgcctgtgtttctgagtctttaaataaaaatgaacatggagaagg

SEQ ID NO: 138 - DNA, 1422 bp, Homo sapiens
agtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttataaaaaaaaaaaaaaggatgatcaaaacacacagtgtttatgttggaatcttttggaactcctttgatctcactgttattattaacatttatttattatttttctaaatgtgaaagcaatacataatttagggaaaattggaaaatataggaaactttaaacgagaaaatgaaacctctcataatcccactgcatagaaataacaagcgttaacattttcatatttttttctttcagtcatttttctatttgtggtatatgtatatatgtacctatatgtatttgcatttgaaattttggaatcctgctctatgtacagttttgtattatactttttaaatcttgaactttataaacattttctgaaatcattgattattctacaaaaacatgattttaaacagctgtaaaatattctatgatatgaatgttttatgcattatttaagcctgtctctattgttggaatttcaggtcattttcataaatattgttgcaataaatatccttgaacaca

SEQ ID NO: 139 - DNA, 2173 bp, Homo sapiens
aagatgcatgggtccagagtataaaggaacccaggagcagctgaaggcaggtcagatgaaggctaggtggctggaactgcaaccatggtgcccagcttcctctccctgagcttctcctccttgggcctgtgggcttctgggctgatcttggtcttaggctttctcaagctcatccacctgctgctgcggaggcagacgttggctaaggctatggacaaattcccagggcctcccacccactggctttttggacatgccctcgagatccaggagacggggagcctggacaaagtggtgtcctgggcccaccagttcccgtatgcccacccactctggttcggacagttcattggcttcctgaacatctatgagcctgactatgccaaagctgtgtacagccgtggggaccctaaggcccctgatgtgtatgacttcttcctccagtggattgggagaggcctgctggttcttgaggggcccaagtggttgcagcaccgcaagctgctcacacctggctttcattatgatgtgctgaagccctatgtggccgtgttcactgagtctacacgtatcatgctggacaagtgggaagagaaagctcgggagggtaagtcctttgacatcttctgcgatgtgggtcacatggcgctgaacacactcatgaagtgcacctttggaagaggagacaccggcctgggccacagcagggacagcagctactaccttgcagtcagcgatctcactctgttgatgcagcagcgccttgtgtccttccagtaccataatgacttcatctactggctcaccccacatggccgccgcttcctgcgggcctgccaggtggcccatgaccatacagaccaggtcatcagggagcggaaggcagccctgcaggatgagaaggtgcggaagaagatccagaaccggaggcacctggacttcctggacattctcctgggtgcccgggatgaagatgacatcaaactgtcagatgcagacctccgggctgaagtggacacattcatgtttgaaggccatgacaccaccaccagtggtatctcctggtttctctactgcatggccctgtaccctgagcaccagcatcgttgtagagaggaggtccgcgagatcctaggggaccaggacttcttccagtgggatgatctgggcaaaatgacttatctgaccatgtgcatcaaggagagcttccgcctctacccacctgtgccccaggtgtaccgccagctcagcaagcctgtcacctttgtggatggccggtctctacctgcaggaagcctgatctctatgcatatctatgccctccataggaacagtgctgtatggcccgaccctgaggtctttgactctctgcgcttttccactgagaatgcatccaaacgccatccctttgcctttatgcccttctctgctgggcccaggaactgcattgggcagcagtttgccatgagtgagatgaaggtggtcacagccatgtgcttgctccgctttgagttctctctggacccctcacggctgcccatcaagatgccccagcttgtcctgcgctccaagaatggctttcacctccacctgaagccactgggccctgggtctgggaagtagctctgatgagaatggggtcccagatggctcaggctgtgacctccctgggcaccaccctccccaggctgggtgtggaggagttggggccccctgccttcaggaggcttgtagtttagaagggaagtaggcattaccatagacgactcctagaggacagtgctatgtaaaaatgtgtgtctataaatgtttatcatgcatgtattctagagctcattcatttattcaacaaacatttggtgagcacctatttcgttcgagaaacttcatttatctcctataattggcaaacttaaaaatgcagcagaaacttacattccaaccttagagactcatagtgagcacaaggaaagttttgccctgagattcatggttatggctgggtaccaccaaatagaagaatggcttaggggagtgccccttcactgagatgtgtttctttgttgaactttgtgtgtgtgtgtttagaatataacagacataagaaaaaattacctaaatgaagactgtacaaaataataaataattctgaagcagaaaaaaaaaaaaaaaa

SEQ ID NO: 140 - DNA, 4672 bp, Homo sapiens
ttttcctcacactaaatcgaaaactctccctgttggtcctgatctgtttcagtcaggcaaattacatcctgggaaaacgtcagatgacaggggaggccactcgcttcctgctcatccagtttcgacactttctgtgctttcattagcttccagacctcagccctggccctcgctttactgtacagtcagaactggtttctacgcctcgcgagggtgggaggtcgtgtatgggaggaggaccgcttcccaccagcctcgttgggaagccaggagaaatctcttcaaatcctgcgattcagagtcaagtcccagtcgtcctttttctggtcggcccagaactgtttgtgcctcctccctcatgaggaatgatgtcagtggggccgcggtcgccgcccacgaagagtgtaaggctgcgaagtcggggctttcccgacgccccctccgtccgcgtctgcgtaggggaggtgacgagggcggggcgcggcggcggggtgacgtcacggccgcgcgcggcgtgggcggagcctcactttgaacccagttggcgggagtggctgctcgcggaggggcagtgtctgcggggccgctgtatgctgtccagcgatggatcccaccgcgggaagcaagaaggagcctggaggaggcgcggcgactgaggagggcgtgaataggatcgcagtgccaaaaccgccctccattgaggaattcagcatagtgaagcccattagccggggcgccttcgggaaagtgtatctggggcagaaaggcggcaaattgtatgcagtaaaggttgttaaaaaagcagacatgatcaacaaaaatatgactcatcaggtccaagctgagagagatgcactggcactaagcaaaagcccattcattgtccatttgtattattcactgcagtctgcaaacaatgtctacttggtaatggaatatcttattgggggagatgtcaagtctctcctacatatatatggttattttgatgaagagatggctgtgaaatatatttctgaagtagcactggctctagactaccttcacagacatggaatcatccacagggacttgaaaccggacaatatgcttatttctaatgagggtcatattaaactgacggattttggcctttcaaaagttactttgaatagagatattaatatgatggatatccttacaacaccatcaatggcaaaacctagacaagattattcaagaaccccaggacaagtgttatcgcttatcagctcgttgggatttaacacaccaattgcagaaaaaaatcaagaccctgcaaacatcctttcagcctgtctgtctgaaacatcacagctttctcaaggactcgtatgccctatgtctgtagatcaaaaggacactacgccttattctagcaaattactaaaatcatgtcttgaaacagttgcctccaacccaggaatgcctgtgaagtgtctaacttctaatttactccagtctaggaaaaggctggccacatccagtgccagtagtcaatcccacaccttcatatccagtgtggaatcagaatgccacagcagtcccaaatgggaaaaagattgccaggaaagtgatgaagcattgggcccaacaatgatgagttggaatgcagttgaaaagttatgcgcaaaatctgcaaatgccattgagacgaaaggtttcaataaaaaggatctggagttagctctttctcccattcataacagcagtgcccttcccaccactggacgctcttgtgtaaaccttgctaaaaaatgcttctctggggaagtttcttgggaagcagtagaactggatgtaaataatataaatatggacactgacacaagtcagttaggtttccatcagtcaaatcagtgggctgtggattctggtgggatatctgaagagcaccttgggaaaagaagtttaaaaagaaattttgagttggttgactccagtccttgtaaaaaaattatacagaataaaaaaacttgtgtagagtataagcataacgaaatgacaaattgttatacaaatcaaaatacaggcttaacagttgaagtgcaggaccttaagctatcagtgcacaaaagtcaacaaaatgactgtgctaataaggagaacattgtcaattcttttactgataaacaacaaacaccagaaaaattacctataccaatgatagcaaaaaaccttatgtgtgaactcgatgaagactgtgaaaagaatagtaagagggactacttaagttctagttttctatgttctgatgatgatagagcttctaaaaatatttctatgaactctgattcatcttttcctggaatttctataatggaaagtccattagaaagtcagcccttagattcagatagaagcatcaaagaatcctcttttgaagaatcaaatattgaagatccacttattgtaacaccagattgccaagaaaagacctcaccaaaaggtgtcgagaaccctgctgtacaagagagtaaccaaaaaatgttaggtcctcctttggaggtgctgaaaacgttagcctctaaaagaaatgctgttgcttttcgaagttttaacagtcatattaatgcatccaataactcagaaccatccagaatgaacatgacttctttagatgcaatggatatttcgtgtgcctacagtggttcatatcccatggctataacccctactcaaaaaagaagatcctgtatgccacatcagcagaccccaaatcagatcaagtcgggaactccataccgaactccgaagagtgtgagaagaggggtggcccccgttgatgatgggcgaattctaggaaccccagactaccttgcacctgagctgttactaggcagggcccatggtcctgcggtagactggtgggcacttggagtttgcttgtttgaatttctaacaggaattccccctttcaatgatgaaacaccacaacaagtattccagaatattctgaaaagagatatcccttggccagaaggtgaagaaaagttatctgataatgctcaaagtgcagtagaaatacttttaaccattgatgatacaaagagagctggaatgaaagagctaaaacgtcatcctctcttcagtgatgtggactgggaaaatctgcagcatcagactatgcctttcatcccccagccagatgatgaaacagatacctcctattttgaagccaggaatactgctcagcacctgactgtatctggatttagtctgtagcacaaaaattttccttttagtctagccttgtgttatagaatgaacttgcataattatatactccttaatactagattgatctaagggggaaagatcattatttaacctagttcaatgtgcttttaatgtacgttacagctttcacagagttaaaaggctgaaaggaatatagtcagtaatttatcttaacctcaaaactgtatataaatcttcaaagcttttttcatttatttattttgtttattgcactttatgaaaactgaagcatcaataaaattagaggacactattgagagtgagccactagcttgattttctttctcctctgatttcagttcactgttcagtttagcattaaaataataaaataatcatacagttccatttgattgtaatttacttgcatatgattaccttcaaaagctgtgttcttgagggcaatcatttaaggccatacttgtgacctcagaaatgcagctggaaggccgggcgcagtggctcacgcatgtaatcccagcactgtgggaggccgaggcaggctgatcttgaggtcaggagttcaagaccatcctggccaacataatgaaaccccatctctactgtaaatacacaaattagccgggcatgttggtgggcgcctgtagtcccagctactctggaggctgaggcaggagaatcgctggaacccaggaggaggaggttgtggtgagccaagatcgtgccactgcactccagcctgggcaacagaacaagactccgtctcaaaaaaataaaggcagctggaaaattccttcacttagtaactcctttggggaataaggaataaacaaaaagactaaggctttcacttactttactaatgatacggttttgccaccttaatttctattggtgcgtagtccacaatatgtatttgtttaaaatggtactggaggacgggtgcgatggctcatgcctgtaatcccggcactttgggaggctgaggcaggcaagtcgcttgaggcctggagtttgagaccagcctggccaacatggcaaaacctggtctctactaaaaatagaaaaattagccaggtatggtgacgcacacctgtagtcccagctacttgggaggctgaggcatgagaatcgcttgaacccaggaggtggagattgcagtgagctgagatcacatcactgcatttcagcctgggcaacagaatgagactcagtctcaaaaaaaaaaaaaatactactggaacaattaggtgtgatataatgtagcaatttgaatagcttgttcaattttaatagaaaatgtgatgctttacatcttattgtcatttatttaaaacatgcaacattatcagaaacagattggtccttaaaaaacaaaacataattttcttttgcttaataaatataactatcacaagtaaaaaaaaaaaaa

SEQ ID NO: 141 - DNA, 7967 bp, Homo sapiens
gcgcgtgcgctcggctccgcctggtgcggccgcggccgggagggactggattatgtcggccccgtttgaggagcggagtggggtggtaccgtgcgggaccccgtggggccagtggtaccagaccttggaggaggtgttcattgaagttcaggtgccgccaggcacgcgcgcccaggatatccagtgcggcctccagagccggcatgtggcgctgtcggtgggcggccgcgagatcctcaagggcaaactctttgattctacaatagctgatgagggaacatggactttggaggacagaaaaatggttcgtattgttcttacaaagacaaagagagatgcagcaaattgttggacttctctactagaatctgaatatgcagcggatccttgggtgcaagaccaaatgcagagaaagcttacattagagagattccaaaaagaaaatcctggttttgacttcagtggagcagaaatctcaggaaactacactaaaggtggaccagatttctcaaaccttgagaaataactgctttttttcctgcattctgtggatcctagcagatattgccaacttaatcagataaacagattatgtaatggaagaaaaatgcggatgcctacagttaacagattgcaaaatgtatcttaaaatggttctaaaaattgcattcaaacataatttacataggaaatgtactgtgggaactattctatggatatatggtaaagttgttttggacttgtttttgctcagcatgaagttttatatgctgcattttactaattccatatttaaccatatttttaatacaaaagaacattagagtatagatcatgtgaaatgaagggtgcctttggggaaaattaactttttcttttgataagtatgatattcaataaaattttctaaataggaattgtgtacccctttgtctaagtataacaattcacacaaaattatagtgctgaaaacaattttaataaaggaaaaagtccataaatgtattttaagtaaattaagagttaatgtaaatttcttaattagaatattattacttgagggattactttatgtcaagaagtttaaaaatagttaaaaccctaacaatagaagtggattaacacaaaagagaagtgtgatcatggtaattaggtgagtcctttgtggcagaaagcaaagtaaggtcactaattgtatatcagtggcatcattttgattgtaagtgatttaggcatataggtaggaattgtctatagacattttattcaatatcctatttatgtcctttttattttttgccctttttaactcttgaaaaaattttaaatctcatgcatagaaaagttacagataatttttttctttctgaaccatttgtgatttagttgaagacatgattcctcattactgattactatctgcttcaaattatcttacatgactacaatgcaaccattagaatcaggaaatttacgttgacacattactaccctctaatcctcagatcttcacttcattcacattgaactgattgtcccaataatgtccatatagcaagaggatccagtcagaatcatgcctttcatttagatgtcagctgtctttagtttacttcattctggaacaaattctcatttgtttccttttacaacttagtacttttgacaattatgggctagttttgtagaacaccccttattttgagttctgtctgatacttcatgattagattgaggttattcatctttggcaggaatgtgatagaagtgcatcctgtcattgtttaataatttcagtttgtctcatttctgatggtgtttcttagatgactgattaaggtagtgtctgccagacttctccactgtagttatttttataattatttcttgagaagatagttgcaaaatactaccttgtttctgatcagactttaaatttatcgtatctctataaactcattattttctattttattcagcaggttaaaaaacctattatcattacattggtgctcaaaattattgtacatttggctggtagaagtccattctgggtggcctctgtgtccttctgacacattcccatcattattcaatgaatttgttactctctggcataagatataccaggcttctcatgctgtcctcgacctaacccaagaatcagccatttttccgtagagcctgggttctctttagtgagtaatatttaaaagccaagatctgtgctagtgtgcaattgccgttggtgtgtatatataatgcatgtctttacatctatatttctgcatctatgtatattgaaaaccatgaattcacatataaattctgatcccatgggcttcattttcattttttccttctccacatttataaccgttttcagtaccagtgagaaacctgattcctatttgattatttgtggggttttttttttttaaggtggagtttcactcttgttgcccagactggagtgcagtcgcgcgatctcggcttactgcaacctccgcctcctgggttcaagcgattctcctgcctcagcctcccaagtagctgggattacaggcatgcgctgccacacctggctaatttttaatttttggtagagacggggtttctccatgttggtcaggctggtctcgaactccggacatcaggtgatccgcccgcctgggcctcccaaattgctgggattacaggtgtgagccactgcgcctggcctgattctctattgtaggtcatctccccacatgaatgtcttcctcaccctgcttaggcttcgcatcctatgctgagcaggaatgtcctcctcatcctgcctggaccctaatacctcactccaggccatggcagtccattcaccctgtgattcctatcttgctcattttaggaatgaattgtcgggggaagaggctatttttcttttaattttattctctttgacatttaacaaaattttttgagtaaagtaaaattaacttttttggtgtatggtttggtgaattttaagtatagatatgtgtaaacacctccacagtcagagtattgaagagttcaatcaccgtaaaaactctcgtgctctctttgtactctacacaccctactcccagcccctaaaccttggaaaccactgatctaatccccatctccatatttttgtcttcaagcatgttataaatgggatcatatataattaagaaaaacgctttattgtaacaacatacatttcacccatttaaggtgtgtaattcagtagcttttagtatatacacagataaatgcaaccattccaataatcaattttagaatgttttcatcacctcagatagaaaccttgtatagtttagcttttatccttctcctgtcatcccccgccatccatactacctcttttcatctcatagatttccttattctggacatttcatgtacatggaatcataatacgtggtctttggttactggcttccttcactttacatgtcttaagaggttcatctatattcgagcatgtatcagcacattcattagtatgtctgaaaatacttcattgtatggctgtagcactttgtttatacatttgtaagttggacattttgggtatttccaccctttggctgtcctgactaaagctgctataaacgtgtacaagtctttatgtgcatatgtgttttcatttcttacctaggagtagaatttttaggttatatgataactatgttaatcatttgaggagctgtcattgtttcccaaagcagctacatctttttactttcccaccagcagtgtatgcaggttccattttctctgcatccttgccaatacttgtttacctgacattttgattttagtcactctagtggatatgaaatgggatctctatctagttttggtttgctattctctgatactatgttgagcattctttcttgtgcttattggctatttgtgtatcttccttaaagcagtgtttattcaaattatttacccatttttttagttgtcttattgggtagtaagagtctttatatattctgggtacaagtctcttaccaggtatatgatttgtaatttctcctattctctctttactttgttgatagtgtcttttgaagcacagacttaattttgatgaagtcttatccatcatgccattggtggatcatgtttttggtgtcatgtctaggaaccttaaccccaggtcatgaggaatttttcttttttctttttttgactcacattctcactctgtcacccaggctggggtgcagtggcacaatctccactcactgcaacctctgcctgctgggttcaagtgattcttgtgcttcagtctcccaagtagctgggactacaggtgtgcaccaccactcccagcccattttttttttattttttatttttagtagagttgggatttcaccatataggctaggctggtcttgaactgacctcaacggatctgcccgcctcagcctctgaagtgctgggattacaggcatgagccaccgtgcccggcctatggatttttttcttctaaaaattttataaatttagttctacatttagatccgtgatccattttaggttaatttttgtataagctgtgaaatttaggtaggtttatttttttgcatatggatgttcagttgttttaaaatcgtctgttgaaaaactctccattccccattgagttgtcttttcacctttgtcagaaatcaattgctatttatgtgagtctggttttggactttattccatcgatctatgtgtttatcctttcataaataccagattgccttgattatcacagctttatagtaagtcttaaaactgggcagcatgattccttcaaaatttttttgaaatctttttcaaaattgttttggctaatttagtttctttgccttccatatgaattttagaattagctactctgtatctacaaaaaatcctactggggttttgaatgcaattttgtgtcttccaatccatgaacatgaggtatctatttaggacctctttcatttcagttatcagcattttatgtcatttttcagcatatattccacagtgttcattttggaggaactattgttaagttgtattatttttgaaacatgggtttccaattgcacatcgctagtatgtacaaatgtgtttgatttttgtttgttgaccttgtatcctgtgaccttgctaaacttcattagttttgggagttattttgttgttaactcattaagttttctacataaactacgaatagaaacagttttattttattctttttagtctatgatttttcttgcctgattttgttgttaactcattaagttttctacataaactacgaataggaacagttttattttattctttttagtctatgatttttcttgcctgattgcagtggccagaacaataacatggagaaagtggccatctcagtcttgttctggatcttaggattttgaaagcattgtttttgaccattatgtatgcaagctgtaggcttttcttaaattccctttgtcatgttgagcaagttcccatctattaatttgttgttagcagagtttcatgagtggatgctgaattttctatgctctttctgtatcagtttggtcattctttttgtttagactgttaaaatcatggattttactgattccagaattttgaaacagcttatatttcctcccaaccccaaacttggtcatggtacattattcagcttatgtatctagatttttattttttgaggatttttatgtctgtgttcattttggatattgtgcaattgtttttgtttgttttttccttgtgttatctttatcttggtatggtatcatgttaattctggtcttgtaaaatgaattgcaaagtgattattctttctggaagagatttgtagaatttgttatatctttaaatgttttatgaatttgctagtaaggttttaaacaatggttcaatttttaaaaatagagaatttattgaggtttatttaagtttgggtactgtatgcctttcaaggaattggttcatctaatcctatgtgcatagagttgttcatggtattttctttgtgtcgttctaatgaggatctatactgttatcttttctttgattcctaagattggaatcaaagattggaattccttctctttttttgtcaattttgccagaggtttatcaattttactgctcttttcaaaaattagttttttgattgttttctattaatttgtttacaattgcatttattttctgcctcttttttttttttcttctttctgcttgctttaggtttagtttgggcttcttttttttgtagacaggtctcacttcatcacccagactggagtagtgttatgatcatagctcactgcagcctcaaactcgtggggtcatgatcctcctacctcagccttctgagtggctgggactatagtggtgtgccaccacacccagttagattttcctactttcttaaagtgggagcttagagtgttaatttgagaactttttcttgtttagtaaaaagcagtcgattgttataaattgcagcaccagcatggctgcattccaagcacggtgatattttcatttattttaaaatattttttaagacttccctgtagtatcatgagttatttagaaatgtgttgtttaatttccaagtgtttggagattttcttgctgttactgatttctagattatggtcaaaaaacatattttatatgatttcatctcttttaaatttgttaaggtttaagacccatgatgtggtttatcttggtgagtgttccatgtgtacttgaaaagaatgcttattctgctgttttaggtagaagggttttatgtcaattaaatctagctggttattagtattattccattttcctacatctttgctaattttctattaattctatggactactgagagaggaatgtttaagtttccaactgtaaatgaagatttgtccagtcctccttttaatgctaccactttttgcttcatgtttttttttttttttttgagtcttaccctgtcactcaggctggagcatagcaactctgtcatgcttcactgcagcctcaaactcctgggctcagacagtcttcccacctcaggctcctcagtacctaggactacagatgtatatcactatgcctagctaatttttgattttttgtagagatagggtctccctatgttgagtaggctggtcttgaactcttggcctcaagcaatcctcccaccttggcttcccaaagcattggaattacaggaatgaatgagtctctgtacctggtctcttcatgtatttttaagatctgataataagtgcttacacttttagcactgtcttggtgaattttatcattatataatgtccctaattatccttggcaattttggttgttcctaactctactttgatgaatataaaaatggctttttaatttattttttgagacaagagcctcactctgttgcccaggttggagagcagtggtgtgatcttgtctcactgcctcacaggttcaagcaattctcctgcctcagtctctggagtaactggtactacaggcatgcgccaccacacccagctgatttttgtatttttagtagagatggggtttcaccatgttggccatgctggtctcgaactcctggcctcaagtgatccgtccaccttggcctcccaaagtgctgggattacaggtgtgagccactgcgctcggccttaaaaattggcttatcttttaattcatcttgactcatgtttactgttttttggtttctgaaaaatagatttaataaataataacattttatcaaagttattagtatagagaaataaattgagtgttgttattattctatgatcatgatgacagcacagaagttaatgtggccagcatatagttttgattaaaaattatacaagcaa

SEQ ID NO: 142 - DNA, 14612 bp, Homo sapiens
acacaagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacagctagtcaagtatatctttctctgatttgatagtgtgacctaaaaggggaccattgtttgaaatatcattagagttgcttattattattattattattattattattattattattattattattgagacagagtttcattctgctgcccaggctggagtgcagtggcatcatcttggctcattgcaacctctgccttctgggttcaagcgattctcctgcctcagcctcccgagtagctgggattacaggctcctgccaccacacccggctaatttttgtatttttagtggagacagggtttccaccatgttggccagcgtggtcttgaactcctgacctcaggtgattcaccagcctcggcctcccaaagtgctgggattacaggtgtgagccactgcacctggcctattattatttttaaattttttttttttaattgatcattcttgggtgtttctcacagagggtgatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcactgcccttaatccatttaaccctgagtggacacagcacatgtttcagagagcacagggttgggggtaaggtcatagatcaacagcatcctaaggcagaagaatttttcttagtacagaacaaaatgaagtctcccatgtctacttctttctacacagacacagcaacaatctgatttctctatcttttccccacctttcccccttttctattccacaaaaccgccatcgtcatcatggcctgttctcaatgagctgttgggtacacctcccagacggggtggcggctgggcagaggggctcctcacttcccagatggggcggccaggcggacgcgccccccacctccctcccggacgggatagctggccgggcgggggctgaccccccacctccctccccgacggggcggctggccgggcgggggctgacccccacgcctccctcccggacggggcggctgccaggcggaggggctcctcacttctcagacggggtggctgctgggcggagacgctcctcacttcccagacagggtggctgtcgggcggaggggctcctcacttctcagacggggcagctgcgggcggaggggctcctcacttctcagacggggtggccgggcagagaagctcctcacatcccagacgggggggcggggcagaggcgctccccacatctcagacgatgggcggccgggcagagacgctcctcacttcatcccagacggggtggcggccgggcagaagctgtaatctcggcaccctggggggccaaggcaggcggctgggaggcggaggccgtagccagctgagatcacaccactgcactccagcctgggcaacattgagcactgagtggacgagactctgcccgcaatcccggcacctcgggaggccgaggctggcagatcactcgcagtcaggagctggagaccagcccggccaacacagtgaaaccctgtctccaccaaaaaaatacgaaaaccagtcaggcgtggcggcgcccgcaatggcaggcacgcggcaggccgaggcgggagaatcaggcagggaggctgcagtgagccgagatggcagcagtacagtccagcttcggctcggcatcagagggagaccgtggggagagggagaagagagggagggggagagggctatttttaaaattttttaaaattgctgaacaggggtacctctgggcagtgtgtcagaataccactttttaaatattttatgatttatttatttttctatttcttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagagatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcggtggctcacgcctataatcccagccctttgggaggccaaggcgggcggatcacgaggtcaggagatcaagaccatcctggctaacatgtaaaaccccgtctctactaaaaatacaaaaaattagccaggcgttgtggcggtcgcctgtagtccctgctatttgggaggccgaggcaagagaacggcatgaacctgggaggtggagcttgcagcgagctgagatcttgccactgcactccagcctgggcgacagtgcgagactctgtctcaaaaataaataaataaataaataataaataaaatgtttggaatgttggcttcatccctgggatgcaaggctggttcaacatacgcaaatcaagaaacataattcatcacataaacagaactaaagacaaaaaccacatgattatctcaatagatacagaaaaggccttcaataaaattcaacgttgcttcatgttaaaaactctcaataaactaggtattgatggaaaatatctcaaaataataaccatttatgacaaacccacagccattatcatactgaatgggcaaaagctggaagcattccccttgaaaactggcacaagacagggatgccgtctcaccactcctatttaacatagtattggaagttctggccaagaaaatcaggcaagagaaacaaataaggggtattcaaataggaaaagaggaagtaaaactgtgtttgcagatgacatgatactatatctagaaaaccccattatctccacccaaaagttccttaagctgataagcaacttcagcaaagtctcaggatacaaaatcaatgtgcagaaatcacaagcattctatacaccaacaatacacaagcagagagccaaatcatgaatgaactcccattcacagttgctagaaagagaataaaatacctaggaatacagctaataagatgtgaaggatctcttcaaggagaactacaaaccactgctcaaggaaataagagaggacacaaatgaaaaaacattccattctcgtggataggaagaatcaatatcatgaaaatggccatactacccaaagtaatttataggttcattgctattcccattaaactactattgacattcttcacagaattagaaaaaaactactttaaaattcaaatggaaccaaaaaagagcccgtataaccaagacaacaataagcaaaaagaacaaagctggaagcatcacactacccaacttcaaagtatactgcaaggctacagtagccaaaatggcatggtactggtacaaaaacagacacatagaccaatggaacagaatagagaccagagaaagaagaccacacatctacagccatctgatcatcgacaaacctgacaaaaacaagcaatggggaaaagattccctatttaataaatggtgctgggaaaactggctagccatatgcagaaaattgaaactgaccccttccttacaccttatacaaaaattaactcaagattaaagacttaatgtaaaacctaaaactataaaaaccctagaagaaaatctatttaataccattcaagacataggcacaagcaaaggtttcatgacaaaaacatcaaaagcaattgcaacaaaagcaaaaattacaaatgggatctaattaaactaaagagctcctgcacagcaaaagaaactatcattagagtgaacaggcaacctacagaatgggagaacatttttgcaatctatccatctgacaaaggtctaatatccagaacctacaaggaacttaaaacaaatttacaaggaaaaaaacaaccccatcaaaaagtggacaaaggacatgaacagacacttctcaaaagaagacatttatgtggccaacaaacatataaaaaaaagctcaaccttactgatcattagagaaatgcaaaggagaaccacaatgagataccatctcatgccggtcagaatggtgattattaaaaagtcaaaaaacaacagatgctggcgaggctgtggagaagtaggaacacttttacattgttggtgggaatgtaaattagttcaaccgttgtggaagtgtgtgtggctattcctcaaagatctagaactagaaatactatttgtcccagcaatcccattactgggtatatacccaaaggaatataaaccattttattataaagatacatgcacatttttgttcattgcagcactcttcacaatagcaaagacacaatagcaaatgcccatcaaagatagactggataaagaaaatgtggtacatatacaccatggaatactgtgcagtgcagccattacagcttttggtgatacagtgaatcagatttttcattaattcttttaattggttattactgaacgtgaaaaagtaatgtttgtattgaaatcttgagtctggccatgtttctattttaaattcataaagaattctaacaagaggaattccaagaatgtcataaatggatgtttctccatggatgaaggaactgttttattcacttgctgataattcagcctaatccagtttgacatcatatagataagtagttgaattatggatttaaaatacatatcattttctaactccaaaggtaatacttatttaaatggttttgaaaatatagaaaggcacaatttctttttaaatctgttattctccaccaccactcaatctgtctatcatctatctctccattcattcttccatttgtttatatctgttaatctttgtatgtgttcatgtatagcttttacatgattggaatcataatgcatattccattttgaagtctgcttttttttacacaaaaatatgttgtgaatattttcctatattatgaaatatcattagctgagcttttagaattgactgcatgttttggtaccatttagatatagtttaagatacttagaagttatgtggctttgccactatggatgaatcttatttactcaatattaattacttacaaataacctcacctaaacactactcagccataaaaaggaatgaattaatgacattcacagcaacctggagactattactctaaaggaagtaactgaggaatggaaaaccaaacattgtatgttctcactcataagtgggagataagctatgaggatgcaaaggcataagaaggatacaatggactttggggacttaggggaaagggtgggaggggggtgaaggataaaagaatacaaattgggttcagtgtatactgctcaggtgatgggtgcaccagaatctcacaagtaaccacttaattacttacgcatgtaaccagataccacctgttccccaaacacctatggaaataattttgtttttttttttaaaaaaggaatgagatcatgtcctttgcagggacatggatgaagctggaagccattatcctcagcaaactaacagaggagcaggaaaccaaacaccacatgttctcacttgtaagcggaagctgaacaatgagaacacacggacacagggatgagatcaacacacactggggcctgatgcaggggccgtagcggggagagcatcaggataactagctaatgcatgtggggcttaatacctaggtgataggttgataggtgcagcaaaccaccatgggacacgtttacctatgtaacaaacccgcacatcctgcacttgtatccagaacttaaaatattttaaaaatctttagagaatacaaaaaaaaaaaaaaagattcttcaatgcatacacaataaaattgcagttcagtcaaacattggaagtctttctctgactgtctagttggtatcttcattttcagcttcttcaagatcccactccaaacactgttagctcagccaaattgaacagctcatatctcctacctctggatctttggttctggtgattgtatatttctggaccatctggaaccccagcatatcaccctaccccacatctccacatccccaaaatataaccatacttcaagggcagttcaaataccatctccttctatcctccatgaagtcagttatctcttccattggaattatcgccccctctcctgaacagtactatttcgtgtgaatctcctccaagccttcttttcattttatatctcatgctgtaattcttggaaagtatgctgtagctcaagtgcagaattctcatcagttttatctttatatctctcctaaacactttacctgatgaagagcctggcatacacataaatatatattgaatgaatcagtgatggattgaaaagagaaatgatggatctcctaaattttaacttttataaaatattttgatacattcatgaccttactttagcaagcaatgaacgtgatgtaaactattgttgatatagtttttatattggaagtgtaagtagtttgtggcatgggattgtgacatatcctaggtttcctcatcttctttttattgaaatgtaattcacaagccataaaatttgcccctttaaagtaaatgatgcagtggattttagtatatttacagagttgtgcaatcatcaccactatctaattccagaacatttccatctacctagaaactccataccagtgagctgccactctaatcctcctcttcccccagcctctagaaacaataatccattttctgtctctatgatttgcctgttctagatattttataaaaataaacatgtggcctttcgtgtctgacttccttcacttagcatgtttcaaggttcatctatgctatagagtgtaccagtgcttcattacattttatggctgaataataccctattgtgtggatataccgcatttagtttattcatcagttgatcgaaatttagactgtttccacttttttgctattatggatgatgctgctatgaatattcgtatatgaatttttatatggatatatgttttcagttcttctgggcatataccttagaagtgagagtgctcatcatatagtaactctatgtttagccttttgaggaactgccaaactgcttttcaaagtagtagcatcattttatattcccaccagcagtgtatgaggttttttttatttttttgtttttgagacggagtctcactctgtcgcccagggtggagtgcagtggcgttatcttgattcactgtaacctctgccttctgggttcaagccattctcctgcctcagcctccctagtagttgggagtagctgggtttacaggagctcgccaccatgcccaactaatttttgtattgttttttgagacggagtctcgctctgtggcccaggctggagtgcagtggtgcaatctcagctcactgcaagctccgcctcctgggttcatgccattctcctgcctcagcctcccaagtatctgggactacagccgccctccaccacgcccggctaattttttgtatttttagtagagacagggtttcaccgtgttagccaggatggtctctatctcctgacctcgtgatccgcctgccttggcctcccaaagtgctgggattacaggcgtgagccaccgcgcccagccaatttttgtatttttagtaaagacagggtttcaccatgttggccaggctggtctcgaactcctggcctcaggtgatctgactgccttggcttcccaaagtgctggcattacagacattagctactgtgcctggcctcaagtcctttctcattttaaaactgcgttattttattttatttttctgagatggaatctcactctgtcgcccaggttggagtgcagtggtgcaatctcggctcactgcaacctccacctcctgagttcaagcgactctcctgcctcggcctccctagtaactgggattacaggcacccaccatcacgcctggctaatttttgtatttttagtagagacagggtttcgccatgttggccaggctggtcttgaactcctgaactcaggtgatctgcctgcctcggcctcccaaaatgctaggattacaggcgtgagccaccacacccggtgggttgtctttttattgttgagttgtaagcattctttttaatattctggatactagtttcttatcaggtacaatctttgtgaatatattctcccattccatggattgtcttctcactttctggatactatacagtacaagttttaaattttgatgaagttcacttgatttctgttttttatgttattgcttatgcttttggtgtcatacctaaaaaaccattgtctaaatcaattgcctatgaggtgttacccctatgttttcttctaaagttttatgattttagctctttgacccattttgagttatttttgtgtatgcagtgcgagataagcatccagcctcattcttttgcacataaatgttcacttgtcttagcattacttattgaaaatactattttttccctatagaattattttatacttatcacaaatcaactaactataagggtttatttctggactcaattctgttgctctatcttatggtagtaccacactgtcttgattattgtaacttcgtagtaagttttggaatccagaaatgtagtcctctaactttgttgttgttgttgttcttcttttttcttttgtagagatgaggccttgctatgttgcccaggctggtctcaaactcctggcctcaaacaatcctcccacctccacctcccaaagtgctgaggggtgagccactgcaactggcctgttctttttcaaaattgttagggctgtattgggtttacctttccctaaattttcatataactgttaggattcacttgcaaatttatgtaaaaagggcctctggaattttgatagtgattacactgaatgagaggagtttggcaggactggtttcccaagaccacaagaccctgtaagaccctgctgataagacaggatgtggtagaaaggccaacccaaaccagccaaaaccatgatggtgacagaagagacctctggttacctttgctgcccattctatggtaattataatacattagcacgctaaaagaaacttctacagcaccatgatagtttacaactgccatagcaactttcagaagttaccctgtatggtctaaaaggtccagacctccccacttctttcctggaaaactcatgaataagccacctcttgtttagcgtatagtcaagaagcaaccataaatatagccagtcagcagcccatcagggctactcttcctatggggtagccattcttttattcctttactttcttaatgaacttgctttcactttattctgtcagcatgctcttgaattctttcctgaacccacttgacctcttgggctgagccttaaccttggggtacttttgcctataacaaacatacaaagataagtttggctgggcgcagtggctcatgcctgtaatcccaggactttgggaggctgaggatggtggatcgcttgagccaaggaatttgaggccaccttgggcaacacggcaaaaccctgtctctactaaaaatacaaaaattagctgggtatggtagcatgcgcctgtagtaccagctactcggaaggctgaggtgggaggatcacttgagcccgggaggtggaggtttcagtgagctgagattgtgccactgtactccagcctggggaacagagtgagaccctgtctcaaaataaaaataaatttgaggtgtattgccatcttaacggaagttgttactggtggacggtatccaagttactggtggtaaatctgcagcaacctcaattctttcctcctcagaagaaagaatttgactgaggggcataaggcagaaggagggaccgaggcaagtttcagagcaacagtgaaagtttattacgctttaggctgggcacagtggctcatgcctgtaatcccagcattttgggaggctgaggcaggtggattacttgaggtcagtagttcgagaccagcctggccatcatgatgatgaaacctcgtctctactaaaaatagaaaaatcagctgggcatggtggtccatgcctctaatcccagctactcgggaggctgaggcaggcgaatcagttgaacctgggaggcggaggttgcagtgagccaagaaagtttattaagctttagaacagtaaggaaaggaaagaaaagaaggaaagtataacttggaagagggccaagcaggtgacctgagaaaccaggtgcagggcttgccctcttgacttggggttttatatgctggcatacttccgggatcttgtgttacttttccccactcctgagatctttttgagaagctgatgatcagtctcaggtgttttctattgcggggggggggggcgggcgggggagctgcctgtccctggcaccacctgtgaccaattattactttacagaaacatttaacaaccgcctgaccatcacctgatggttgcccaacactcttggtgtgtgtcgggggagccctctcctgccttgctcagacctgaatgtacccattgtaacaaaccccttctttgtatactttgatatggtgacatttcttgtcacttgcctcattgtgaatttttatagatgtggctaagtcatatgcttccttctgaaaaattatgtcaaatactagcagtttctcactgttttttgccctagaaacaacaaactaaccttgaagtgaaaggcctttctgcgtttatcttaccttttttgagcagcattaaaactgttttactcagaccaa

SEQ ID NO: 143 - DNA, 2134 bp, Homo sapiens
aaacggggcccaaggcaggggtggcgggtcagtgctgctcgggggcttctccatccaggtccctggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggttccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatgttaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttcagtttccctgta

SEQ ID NO: 144 - DNA, 14167 bp, Homo sapiens
actcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgttttttttttttctttttttttggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctactttttgtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggtttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaagaggtctgcattatgcttgcatgtcaaaaactttaaaaatcctataatcttctgtcattttcactgagtttccatgggaaaggaatagtaaataatgggtagttgaaatattactcttaagaccaagacctgtatctccagtcatatctgtaataacatcatctgataacctaaaagcatagtattagggatatacgacaaaaccaaagtgtttttgctgttgtcacataccactcaatacttttacaccaggttgtccagtggacaccagctggatgtcctataattcaattctgacactgtctacctggaattggagtcagatcccacaggtggagggctcagcccacaagactgcccccactccagataccaatcgcaagtccctatacttctgactggctataaagtggggttcccgtgaccctttccttggttttgatttatttgctagagcagctcccagaacacagagaaacactctacttatgtttacccatttttaattttattactttattaaaactacatattggttacaatactaatttattgtaaaggatatttcatttatttatttttttatttagagatggagtctcactgtgtcacccaggctggagtgcggtggcacagtctcaactcactgcaacctccacctcctgagttcaagcgattctcatgcctcagcctcccaagtagctgggattacaagtgtgcaccaccatgcccagctaatttttgtatttttagtagagatggggtttcactctgttggccaggctggtctcaaactcctgacctcaagtcatccacccacctcagcctcccaaagtgctgagattacaggtgtgagccattgcctctggcttgtaaaggatatttcaaagaatacagatgaacagccagatggaagagatgcacagggcaaggcatgtgggaaggggtatggagctttcatgctctctccacgtcatcagctacccagaagctcatctggaccccgaccctttggggttttacggaggcttcattatgtcagcattaccattggcaattggcgattaactcaaccttcagcctctctcccctttctggaggttgggggttgaggctgggagtccaaaccctccaatcttgccttggtctttctggtaagcagccccccgtcctgaagctacctagaggctcccagccaccaatcatttcattggcaaaccaaagatacttcaaggggtttaggagccaagagaccaagcaaggattgagacaatatatatatttcttataaataacatgatcacaaatagtattttatatatttctcataatagctggttgtggttactcacacctatcatcccagctactaagaagctaaggcaggaggatcacaggcccaggagtttgcagctgtagtgagctatgattgtgctactgcactccagcctgggtgacagtgtgagaccctgtctcttaaagttcttgtaacatcttagaacattaaccaaccacagattattgccttaactctgaaaaataaagtaatcatacttttacaagatgtattttacataaagttctggtgatattttactctggtcattggaatataggagcttaccacctggtaccactcttcctaaagtggtatactatttggtatagtactggcatactatttggaaagggatgtgaagttggcatgacctgtctagggtgaagtcatgctgtctgctattcattgtgggctttacagtaatgagagtgcttctgttgtcaagatgcttctgggacacgttaaaaaaaatttaagatttctcagtttgtgaaaaggaaggagcacgaatgctttcaagttcctatgacatgctagtcatctttcagtgtgtcccattgttgcacccagtagtctcgatgcccagcgtcacggtgattccaagtttgcctctctgcccactataatttgtgctccatgaagtcccaggacatgaggttcttgttcatttgtgcgtctgggcccatatccaaatattaaacaatgtgacttaatgtatttatcatattgtaaatatgggtatccccaaggctcagaagttaacacagcatatccacagagaggtttgacagcatggctgtggtgactgggaaggccttatgcttgctcctccttctgctgcttgcctttgtgtgggcatggaaagaacattgaattaggtactggaagacctgggtcctggtcttggagattttaccagagcacctgtgggatattggtcaagatgcctggttttagtcctgctcctttgctgtgaaagaggatcttaaggtgccaactctggcattttattttttacttatttatttttaaattatactttaagttctagggtacatgtgtacaacatgcaggtttgttacatgtatacatgtgccatgttggtgtgctgcacctattaactcgtcatttacattaggtatatctcctaatgctatccctcccccttctccccacccctcgacaggccccggtgtgtgatgttccccttcctgtgtccaagtgttctcattgttcaattcccatctatgagtgagaacatgcggtgtttgtttttttgtccttggaatagtttgctgagaaggatggtttccagcttcatccatgtccctataaaggacatgaactcttccttttttatggctgcatagtattccatggtgtatatgtgccacatcttcttaaaccaatctatcattgatggacatttgggttggttccaagtctttgctattgtgaacagtgccacaataaatatacgtgtgcatgtgtctttatagcagcatgatttataatcctttgggtatatacccagtaatgggatggctgggtcaaatggtatttctagttctagatccctgaggaatcgccacactgtcttccacaatggttgaactagtttacagtcccaccaccagtgtaaaagtgttcctatttctccacatcctctccagcacctgttgtttcctgactttttaatgattgacattctaactggtgtgagatggtatctcattgtggttttgatttgcatttctctgatggcccatgatgatgagcatttttttcatgtgtctgttggatgcatggatgtcttcttttgagaagtgtctcttcatatccttcacctactttttgatggggtttgtttttttcttgtaagtttgtttgagttccttgtagattctggatattagccctttgtcagatgagtagattgcaaaaattttctcccattttgtaggttgcctgttcactctgatggtagtttcttttgctgtgcagaagctcttgagtttaatgagatcccatttgtcaattttggcttctgttgccattgcttttggtgttttagacatgaagtccttgcccatgcctgtgtcctgaatggtactgcataggttttcttctagggtttttatggttttaggtctaacatttaagtctttaatccatcttgaattaatttttgtataaggtgtaaggaagggatccagtttcagctttctacatgtggctagccagttttcccagcaccatttattaaatagggaatcctttccccatttcttgtttttgtcaggtttctcaaagatcagatagttgtagatgtgtggtattatttctgagggctctgttctgttccattggtctatatctctgttttggtactagtaccatgctgttttggttactgcagccttgtagtatagtttgaaatcaggtagcgtgatgcctccagctttgttcttttggcttaggatcgttttggcagtgcaggctcttttttggttccacatgaactttaaagtagttttttccaattctatgaagaaagtcatgggtagcttgatggggatggcattgaatctataaattaccttgggcagtatagccattttcacgatattgattcttcctatccatgagcatggaatgttcttccatttgtttgtgtcctcttttatttccttgagcagtggtttgtagttctccttgaagaggtccttcacatcccttgtaagttggattcctaggtattttattctctttgaggcagttgtgaatgggagttcactcatgatttggctctctgtttgtctgttgttggtgtataagaatgcttgtgatttttgcacattgattttgtatcctgagattttgctgaagttgcttatcaaattaaggagattttgggctgagatgatggggttttctaaatataaaatcatgtcatctgcaaacagggacaatttgacttcctcttttccttattgaataccctttatttctttctcctgcctgatggccctggccagaacttccaacactatgttgaataggagtggtgagagagggcatccctgtcttgtgccagttttcaaagggaatgcttccagtttttgcccattcagtctgatattggctgtgggtttgtcatagatagctcttattattttgagatatgtcccatcaatacctaattcattgagagtttttagcatgaagggctgttgaattttgtccaaggccttttctgcatctgttgagataatcatgtggtttttgtctttggttctgtttatatgctggattacttttattgatttgtgtatgttgaaccagccttgcatcccagggatgaagcccacttgatcatggtggataagctttttgatatgctgctggattcagtttgccagtattttattgaggatttttgcattgattttcatcagggatattggtctaaagttctctttttttgttatgtctctgccaggctttggtatcaggatgatgctggcttcataaaatgagttagggaggattccctctttttctattgattggaatagtttcagaaggaatggtaccagctcttccttgtacctctggtagaattcggctgtgaatccatcttgtcctggactttttttggttggtaggctattaattattgcctcaatttcagagcctgttattggtctattcagggattaaacttcttcctggtttagttttgagagggtgtatgtgtccaggaatttatctatttcttctagattttctagtttatttgcatagaggtgtttatagtattctctgtgtactctgtatttctgtgggattggtggtgatatccactttatcattttttattgcatttatttgattcttctctcttttcttgtttattagtcttgctagcggtctatcaattgtgtttatcttttcaaaaaaccagctcctggattcattcattttttgaaggtttttttgtgtctctgtctccttcagttctgctctgatcttagttatttcttgtcttctgctagctgttgaatgtgtttgctcttgcttctctaatatttttaattgtgatgttagagtgtcaattttagatctttcctgctttctcttgtgggcacttagtgctgtaaatttccctctacacactgctttaaatgtgtcccagagattctggtatgttgtgtctttgttctcgttggtttcaaagaacatctttatttctgccttcattttgttatgtacccagtagtcattcaggagcaggttgttcagtttccatgtagctgagtggttttgagtgagtttcttaatcctgagttctagtttgattgcactgtggtctgagacagtatgttataatttctgttcttttacatttgctgaggagtgctttacttccaactatgtggtcaattttggaataggtgcgatgtggtgctgagaagaatgtatattctgttgatttggggtggagagttctgtagatgtctattaggtctgcttggtgcagagctgaattcaattcctggatatccttgttaactttctgtctcgttgatctgtctaatattgacagtggggtgttagagtctcccattgttattgtgtgggagtctaaatctctttgtaggtctctaaggacttggtttatgaatctgggtgctcctgtattgggtgcatatatatttaagatagttagctcttcttgttgaattgatccctttactatcatgtaatggccttctttgtctcttttgatctttgttggtttaaagtctgttttatcagagactaggattgcaaccccggcctttttttttgttttccgtttgcttggtagatcttcctccatccttttattttgagcctatgtgtgtgtgtctctgtacgtgagatgggtttcctgaatacagcaccctgatgggtcttgactctttatccagtgtgccagtctgtgtcttttaattggagcatttagcccatttacatttaaggttaatattgttatgtgtgaatttgatcctgtcactaggatgttcactggttattttgctcgttagttgatgcagtttcttcctagcctcaatggtctttacaatttggcatgtttttgcagtggctgatactggttgttccattccatgtttagtgcttccttcaggagctcttgtaaggcaggcctggtggtgacaaaatctctcagcatttgcttgtttgtaaaggattttatttctccttcacttatgaagcttagtttggctggatatgaaattctgggttgaaaattcttttcttcaagaacgttgaatattgacccccactctcttctggcttgtagagtttctgctgagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatttgaatgttgtcctcccttgctagattggggaagttctcctggataatatcctgcagagtgttttccagcttggttccattctccccgtcactttcaggtacaccaatcagacgtagatttggtcttttcacatagtcccatatttcttggaagctttgttcgtttctttttactcttttttctcttaacttctcttctcacttcatttcattcatctgatcttcaatcactgataacctttcttccagttgatcgaattggctactgaagcttgtgcattcgtcacgtagttctcatgccatggttttcagctccatcaggtcatttaaggacttctctatgctggttattctagttagccatttgtctaatcttttttcaaggtttttaggttctttgtgatgggttcgaacttcctcttttagcttggagaagtttgatcatctgaagccttcttctctcaactcgtcaaagtcattctccgtccagctttgttctgttgctggcaaggagctatgttcctttggagggggagaggcgctctgatttttagaattttcagcttttctgctctgttttttccccatctttgtggttttatctacctttggtctttggtgatggtgatgtgcagatggggttttggtgtggatgtcctttctgtttgttagttttccttctaacagtcaggaccgccagctgcaggtctgttggagtttgctggacgtccacgccagaccctgtttgcctgggtatcacagtggaggctgtagaacagcgaatattgctgaacagcaaatgttgctgcctgatcattcctctggaagcttcatctcagaggggtacccggccatgtggggtgtcagtctgcccctacttgggggtgcctcccagttaggctactcgggggtcagggactcacttgaggaggcagtctctccgttctcagatctcaaactctgtgctgggagaaccactggtctcttcaaagctgtcagacagggacattgaagtctgcagagatttctgctgccttttgttcggctatgccatgcccccagaggtggagtctacagaggcaggcaggcaggcctccttgagctgcagtgggctccacctagttcgagcttcccggctgctttatttacctactgaagcctcagcaatggtgggctcccctcccctagcctcactgccaccttgcagttcgatctcagactgctgtgctagcaatgagcaaggctccatgggcgtgggaccctccgagctaggcacaggatataatctcctggtgtgccgtttgctaagaccattggaaaaacgcagtattagggtgggagtgacccaattttccaggtgccgtctgtcacagcttcccttggctaggaaagggaattccctgaccccttgccttcccgggtgaggccatgccttgccctgcttcagctcatgctcagtgggctgcacccaccgtcctacacccactgtccaacaagccccagtgagatgaacctggtacctcagttggaagtgcagaaatcacctgtcttctgcgtcgctcacgctgggagctgtagactggagctgttcctattcggccatcttggaacccaacccaagtctggcattttttggttttctctgtgtattgactatgattatagaggataaatggatattgatattattaaatcgtcatttacagaaggcacacaacttatatcctttaaacaaagttctccaaccagtagggtatacttgctggtagtgcttacagctgccaccattcttcactggggctcagagtggatgcctggaggaaaaaaacaaatgaatcttttagctcctagttactgttagcatttttaccagaaaacaatttaaaaaatgacacaagtaagtcttcacctatcaaggctgagtgtggtggcctatacttgtaatctctgtgctttgggaggccaacgcaggaggatctcttgagtccaggagtttgagaccagcctgggcaacaaagcaagaccccatctctacagaaagttaaaatttagctgggcatgctggcacatccctatagtcccagctacttgagaggctgagttgggaggatcccttgaggtcatgagttggagtctacagtgagctgtgattacagtgtgagtctacactgcactccagtctgggtgaaagagatcctgtctctcaaaaaacaagtgattctcctgggaagagatttgtttaaaaagtctgcacctctattgatgataactttgaatgtaaatggattaaattctcccacttaaaagatatagattgactgaatggattaaaaaccaccatcatgactcgactgtatgctgcctacaagaaacctcacctgtaaagacaggccaaaagtgaaggtatggagaaagatattgcatacaaatggaagccaaaaaagagcagaaataactatacttacatgagataaaatagactttaagtcaaaaactgtaaaaagaaaagtcattatgtaatgaaacaaggatcaattcatgcaagatataatcatatttttttattaagaaaatttttttgtagagatggggttatgctatgttgcctggctagtctcaaactctgggtctcaaagcagtcctcctgctttggcctcctaaggtgctgggattataggcatgagccactgtgccaggcctgaggatattatcattataaatatatatgtaccccacactggatgacccagatataaagcaaatattattagatttaaagggagaaatagactctaatacaatagtagttgaggacttcactctactctcagcattggacagattttctagacataaaaccaataaatattggatttaaattgcactttacaccaaatggacctgacatttacagaacattctaataggtgcagaacactctaatagctgcagaacacacgttcttttcatcagcacatggaacattcaccagactagttctggaacccacttcctgccttagtgttctttccaccacagtgcatgataattccgacagaacgccttttatttgtaccttattagttgtagggggaaagctttttcatgtacaaaaatgctgtaattttctgatttaataaagtaattccactga

SEQ ID NO: 145 - DNA, 5547 bp, Homo sapiens
agaattcggagcgcggaagagccagagctgcgagcgcctggagctggatctctctccggtcgcgcacgccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgttggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattccctcgtcttcacttaaaagccagagtgcaagtcatgatttgcgggagggctcttgaaccacttctggctgcaccacaattctgtacttgagtatcacagtcattgtttttgagacaaacatttttataattctaatttgggttaataaagattttaaatatttcttggtttacttttgtaattatatacacaacaaatgtattaataactaccttgttaaacaccttttaatagcacaaggtttttatatttgcaagctgttgatatctttctaaaactgtttaggttatagtctattgatactttttatatacaattttataaatataaatattataattttatattaatggtaccaaaaatacatttcttaaggttaaaagcatgcacttccatgcatacttgcttttggggagagtggggagaagacattctaataatcagtttgtgaaatagcttctgttggaaaccttttgaggggaataaggaatggtcatctaaaatgagagattctggattttaatgcagttcaaagttgagctgtatttttgttgttgatttatctggattttttttaaagccttctaaaacccagtgaattcaataccttaattagtacatactatcttatgtaatgcataaagcaatgccagtcactgagaacatttaaatatatttatattcctggagatacacattctcatttttgttggtttattataaattattcttctagatgcatcttttataactaggatttcattttgtgtgtatagcttatgtaataaattttaaaggtgaaaactctcttaaa

SEQ ID NO: 146 - DNA, 4668 bp, Homo sapiens
ccagcgctgctccccgggcgctcctccccgggcgctcctccccaggcctcccgggcgcttggatcccggccatctccgcacccttcaagtgggtgtgggtgatttcctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaagaacagcagatttgcagtggaacagttctaatgctcagttgctcctggactactgctcttccaaggggtataacatttcttgggaactaggcaatgaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccaaggaagattttctaaaccctgatgtattggacatttttatttcatctgtgcaaaaagttttccaggtggttgagagcaccaggcctggcaagaaggtctggttaggagaaacaagctctgcatatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgacactgaatttttcaagtatactaagagtaaagcaactcaagttataggaaaggaagcagataccttgcaaagcaactagtgggtgcttgagagacactgggacactgtcagtgctagatttagcacagtattttgatctcgctaggtagaacactgctaataataatagctaataataccttgttccaaatactgcttagcattttgcatgttttacttttatctaaagttttgttttgttttattatttatttatttatttattttgagacagaatctctctctgtcacccaggctggagtgccatggtgcgatcttggctcactgcaactttaagcaattctcctgcctcagcttcctgagtagctgggattataggcgtgtgccaccacgcccagctactttctatattttttgtagagatggagtttcgccatattggccaagctggtctcgaactcctgtcctcgaactcctgtcctcaagtgatccacccgcctcagcctctcaaagtgctgggattacaggtgtgagccaccacacccagcagtgttttatttttgagacagggtatcattctgttgcccaggcttgagtgcagtggtgcaatcatagatcactgcagccttttaactcctgggctcaagtcatcctcctgcttagcctcccaagtagctaggaccacagacacatgccatcacacttggctatttttaaaaaattttttgtagagatggggtctcgctatgttacccaaactggtcctgaactcctggactcaattgatcctcccaccttggccttccaggtgctgggatttctttgggagtacagcatggtacagcaggagatcatttgatgttacctctgtgcagtgttgctagtcagcgaaagactataatacctgtggggacagcgattagccaccacaaccagtctttatttaaagttattaaaaatggctgggcgcagtggctcacacctgtaatcctagcactttgggaggccgaggcagatggatcacctgacgtgaggaatttgataccagcctggccaacatggtgaaaccccatctctactaaaaaatacaaaaattagctgggtgtggtcctgtagtcccagctacttgggaggctggggcaggagaattacttgaacccaggaggcagaggttgcagtgagccgagattgtgccactgcactccagcctgggtgacagagagagattccatctcaaaaaaacaagttattaaaaatgtatatgaatgctcctaatatggtcaggaagcaaggaagcgaaggatatattatgagttttaagaaggtgcttagctgtatatttatctttcaaaatgtattagaagattttagaattctttccttcatgtgccatctctacaggcacccatcagaaaaagcatactgccgttaccgtgaaactggttgtaaaagagaaactatctatttgcaccttaaaagacagctagattttgctgattttcttctttcggttttctttgtcagcaataatatgtgagaggacagattgttagatatgatagtataaaaaatggttaatgacaattcagaggcgaggagattctgtaaacttaaaattactataaatgaaattgatttgtcaagaggataaattttagaaaacacccaataccttataactgtctgttaatgcttgctttttctctacctttcttccttgtttcagttgggaagcttttggctgcaagtaacagaaactcctaattcaaatggcttaagcaataaggaaatgtatattcccacataactagacgttcaaacaggccaggctccagcacttcagtacgtcaccagggatctgggttcttcccagctctctgctctgccatctttagcgctggcttcattctcagactctggtagcatgatggctgtagctgtttcatgggccccttcaaacctcatagcaaccagaggaagaaaatgagccattttttgagtctccttcatagacttgaataactctttttcagagcttctcacagcaaacctctcctcatgtctcctcatgtcttattgttcagaaatgggtaatgtggccatttcaccagtcactgccaacaacaacgaggttcctataattgtctctgagtaaccctttggaatggagagggtgttggtcagtctacaaactgaacactgcagttctgcgctttttaccagtgaaaaaatgtaattattttcccctcttaaggattaatattcttcaaatgtatgcctgttatggatatagtatctttaaaattttttattttaatagctttaggggtacacactttttgcttacaggggtgaattgtgtagtggtgaagactcggcttttaatgtacttgtcacctgagtgatgtacattgtacccaataggtaatttttcatccattaccctccttccgccctcttcccttctgagtctccaacatcccttataccactgtgtatgttcttgtgtacctacagctaagcttccacttataagtgagaacatgcagtatttggttttccattcctgagttacttcccttaggataacagcccccagttccgtccaagttgctgcaaaatacattattcttctttatggctgagtaatagtccatggtacatatataccacattttctttatccacttatcagttgatggacacttaggttaattccattcaatttcattcaatttaagtatatttgtaaggagctaaagctgaaaattaaattttagatctttcaatactcttaaattttatatgtaagtggtttttatattttcacatttgaaataaagtaatttttataatcttgaaaaaaaaaaaaaaaaa

SEQ ID NO: 147 - DNA, 1773 bp, Homo sapiens
agaagtggttctcatctttttttgcagcttaagatctgccttggtatttgaagagatataaactagatcaatttctttcacaggatcaactaaacagtgtaccacaatgaattctgaacttgactattatgaaaagtttgaagaagtccatgggattctaatgtataaagattttgtcaaatattgggataatgtggaagcgttccaggcaagaccagatgatcttgtcattgccacctaccctaaatctggtacaacctgggttagtgaaattgtgtatatgatctataaagagggtgatgtggaaaagtgcaaagaagatgtaatttttaatcgaatacctttcctggaatgcagaaaagaaaacctcatgaatggagtaaaacaattagatgagatgaattctcctagaattgtgaagactcatttgccacctgaacttcttcctgcctcattttgggaaaaggattgtaagataatctatctttgccggaatgcaaaggatgtggctgtttccttttattatttctttctaatggtggctggtcatccaaatcctggatcctttccagagtttgtggagaaattcatgcaaggacaggttccttatggttcctggtataaacatgtaaaatcttggtgggaaaagggaaagagtccacgtgtactatttcttttctacgaagacctgaaagaggatatcagaaaagaggtgataaaattgatacatttcctggaaaggaagccatcagaggagcttgtggacaggattatacatcatacttcgttccaagagatgaagaacaatccatccacaaattacacaacactgccagacgaaattatgaaccagaaattgtcgcccttcatgagaaagggaattacaggagactggaaaaatcactttacagtagccctgaatgaaaaatttgataaacattatgagcagcaaatgaaggaatctacactgaagtttcgaactgagatctaagaaggtctttctttacttaacatatctgatattaaagatttcttttcattattctccactttttcttattttagattgctagaaaagacataatcatggattatgttgacattttctttttaaatttttgtttaactttttttttttttttttgagacagagtctcactctgttgcctaggctggaggacagtggcacaatcatggctgattgcagccttgacctccttgactcaattgatcctcccatctcagcctcccaagtagctaggactacagacatgtgcaaccatgtttggctaatttttttaatgtttttttgtagagatgaggtcttattatattgtccaggctggtcttgaattcctgggctcaagcttcccaagtagctgcaacaacaggcacacaccaccatgctcaactaattttatttctattttttgtatagacaggggcttgctatagtgtccaggctggtctgaaacccttgagctcaagtgatcttcccacaccagcctcccaaaatactgggattacaggcttgagcctccatgcctggcccaggtaacatgtttattgagctgtacatgcatatgagaaataagaaacttttttttcctactatcatctcttaaattttgttttctttttcttttgcttcctcttcttcttttctattttttataaatatcatgcacaactataacctatgggaatgatgtagtaacacagattattcatcttgttagagttgtattaaaaataaacaagcatttcaaatta

SEQ ID NO: 148 - DNA, 1527 bp, Homo sapiens
ggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatattatttctattgtctttgtcttaatatgctaagttaattttcactttaaaaaagccatttgaagaccagagctatgttgatttttttcggtatttctgcctagtagttcttagacacagttgacctagtaaaatgtttgagaattaaaaccaaacatgctcatatttgcaaaatgttctttaaaagttacatgttgaactcagtgaactttataagaatttatgcagttttacagaacgttaagttttgtacttgacgtttctgtttattagctaaattgttcctcaggtgtgtgtatatatatatacatatatatatatatatatat

SEQ ID NO: 149 - DNA, 1342 bp, Homo sapiens
gaaatcggaaagttggcggggctgcgggagctgagcctagagtccggctgttggctagagtgggcgcggatctggtgtggggaaggcggcgggactcaggcctgcctgcgaagcattgtcctacataatggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagaagaacgaatggttgagatgtttctggaatatcaaaatcagatcagcaggcaaaataagctcattcaagaaaaaaaggataacttgttaaaattgattgctgaagtaaaaggcaaaaagcaggaattggaagtactgactgcaaatatccaggatcttaaggaagaatattctaggaagaaggaaactatttctactgctaataaagcgaatgcagagaggttgaaaaggctgcagaaatctgcagacttgtataaagatcgacttggactagaaattcgaaaaatttatggtgagaaattgcagtttattttcactaatattgaccctaagaatcctgagagcccatttatgttttccttacatctcaatgaagcaagggactatgaagtgtcagatagtgcccctcatcttgagggcctagcagaatttcaagagaatgtaaggaagaccaacaatttttcagcttttcttgccaatgttcggaaagcttttactgccacggtttataattaacatacaaatagtgtatataaaaacggtttatttttcttctctattacatatctctttttttcttgtttttattattattatactttaagttttagggtacatgtgcacaatgtgcaggtttgttacatatgtatacatgtgccatattggtgtgctgcacccattaactcgtcatttcattaggtatatctcctaatgctatccctcccccctcccccaacccacaacagtccccgttgtgtgatgttccccttcctgtgtccatgtgttctcattgttcaattcccacctaggagtgagaatatgtggtgtttggttttttgtcctttcgatagtttgctgagaatgatggtttccagcttcatccatgttcctacaaaggacatgaactcatccttttttatggctgcatagtattccatggtgtatatgtgccacattttcttaatccagtctatcattgttggacatttgggttggttccaagtctttgctattgtgaatagtgccgaaataaacatacgtgtgcatgtgtcttta

SEQ ID NO: 150 - DNA, 4761 bp, Homo sapiens
gccattttgtgcagtcgctgggaaggaaggagacgcctaaaccgcggcactgcccggtttgagcgtagccaaacctgcccaccggctttgtagccccgattctctgtgttttgctcccgtctccgacgagagaggcggcgacggtggcgtctgcgacgggagacagcgcgtcggagcgagagagcgctgcgcctgccgccgccccaacagcggaggcgccgccgccatcggtcgtcaccagaccggagccgcaggccctcccgagcccggccatccgtgccccgctcccagatctctatccttttgggaccatgcgcggaggaggctttggggaccgggaccgggatcgtgaccgtggaggatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccatatgaggttgatgagctacgccgaaagaaggagattacagtgagggggggagatgtttgtcctaaacccgtgtttgccttccatcatgctaacttcccacaatatgtaatggatgtgttgatggatcagcactttacagaaccaactccaattcagtgccagggatttccgttggctcttagtggccgggatatggtgggcattgctcagactggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatggaggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagttgatccaactaatggaagaaataatggctgaaaaggaaaacaaaacaataatatttgtggagacaaagagacgctgtgatgatctgactcgaaggatgcgcagagatggttggccagctatgtgtatccatggagacaagagtcaaccagaaagagattgggtacttaatgagttccgttctggaaaggcacccatccttattgctacagatgtagcctcccgtgggctagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaatatgataggttacatggggcagactgcctaccaataccctcctcctcctccccctcctcctccttcacgtaaatgaaaccactcaagtggtagtgactccagcagacttaattacattttaaggaacactgtctttcctttttttttcctcttcgccttttctttttttttccttttttctttttttttttttaatttttccccccaaccatcgtgatttgtcttttcatgcagattagttagaattcactgccaggtttcttctgcccaccaaaatgatccagtctggaataacattttgtaaaaaaaaaaaaaatatatatatatatatatagctgactggaagagattaatttcttcccccaacttcttgcatgttgaagatatttgagctatttttcatctaaaagagtaaggtattaggcccttttgtgggagccccatgttttgtttttctgagttggtggggagggagggagggggagggctgaattgttttgcagaggaagatggcatctgtgctttaaatttctcattactgggttagaaaacaaagagggattgccctgcacattttcttttgtgcttttaaatgtttcttaagttggaacaggtttcctcgggcctgttttgactgattgctggagtgcatttgatagttaaaaattactaattggttttatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgaacataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggtaggtgagttcatcctcttcatggtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaataa

SEQ ID NO: 151 - DNA, 6110 bp, Homo sapiens
gcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaatcccctctttttctttttttaaaatatatttgagtatgccatacatttatatatatggtgtatatgaatttggtttaaacattttaaaatttattctgattagtttgtgtctttttttttttttttgagagagagagtcctgctctgtcactcaagctggagtgcagtggtgcgatctcggctcactgcaacctccgcctcccaggtccaagcaattctcttgccttgtcctcccaagtagctgggattataggcacacaccaccatgcctggctaatttgtgtctcattttcaagagtagaaaccctaaatattttattttcattccttttccaaattgctatgaatgggattaaaggattacagatgtaaagtctattatttgtgaattctaaatgtagttctgctgttgtacctgtggaaacatcttaaagaagtacatattttgcacgtcctgcacgtgtaccccagaacttaaactataattaaaaagaatagtttcaaaaaaatacatattgatcacagtgtaatgccttggatttatgtggccttgctatactactatataatttaggacagtaactgctagctggggtgtgagttatttattggaagctcctttttagggtagaaaatttgaggagaaatctgaagtggcatgatttacccgcagaagtcctggttggggatagtagatggtgttgaattctctggcccagataggtgagcactcctgactacagatgtgtgttgagtggttctggtgcctgcctcattgtcattttcatagtttatgaagtaatcctggggagctgagacggggagtgtatccactcactatacaactcctcattggactaggaagatagtccagtttctactctgcttctatttgatttgttaccttgtggcaggtatttaaaacaggcatttcctatcaacaggtaggcctctaatgtgagcaactgatcctcttacatactgcttaaatcagagaactgttgcacaagaactaaagaatgatggcaagtttggggtgtatatagttgtataaggaaggctgggcgcagtggctcacacctgtaatcccagcactttgggagcctgaggcaggtggatcacctgaggtcgggagttcaagaccagcctgaccaacatggaaaaaccccgtctctactaaaaatgcaaaattagctgggcgtggtggtgcatgcctgtaatctcagctaactcgggaggctgaggcaggagaattcgcttgaacctgggaggtggaggttgtggtgagccaagatcgtgccattgcactctagcctgggcaacaagcacgaaactccgtctcaaaaaaaaaaagaaaaaaaaaatatatatatatacatatatatgtagatgacccagagattctcagacttttagtttctgacatcattagaatctcagtaatttttttcaggccattccttggccaaaagaaatacctaacagttacatttattaacttatgttctaacaactctagtagccatttgaaaaaaactatacacacacaagagcaaaagtgatgtgatgatttttttaaaaatagagacagtgtcttggctctattgcccaggttggagggtcatagctcattgtgacctcaaactcctgggctcaagcaagcctcccacctctgcctcctgagtagcggagacttcaggcacgtgccaccacgcccgcctaatttttttgtagagatggggctctggctgtgttgcccaggctgtaaggaactcctggcctcaggtgatctgccttggcctaccaaagtgctgggattacaggtgtgagccactgtgcccagcctgatgtgataatttttatctcatccttaaatcatcacagttactaatggaatgtgtgtgccttttgggctccatacagtttctcaaaattgaaatcagattggacaccattgtccttatttcttccacattgatttttgcatggtgctttttgtcatagcagtggctccaaacccagcttcacaaggataggatgccatcaaagggaatgtagtgccatatcatattgaaactgaacttcctggaactagtagtttatacaaaagatgcgtcagtgtcaagtgtttttcctgaggtactccaaggcacttcagcttgcacagtttaggatacttggctataaggagagacagtgggatgacagcttttgatgagaaggaatcaaacctatgatgaggactaatctaacaaaccctgaaaattcccttggaagtattttttaaaaaaggattatactttaaagaccacatctaagggctgggcgcggtggctcacacctataatcccagcagtttgggaggctgaggcaggcagatcacttgcagtcaggagttcgagaccagcctggccaacacagtgaaaccccgtctctactaaacatacaaaaattagctgggcgtggtggtgtacacctgtagtcccagctacttgggaggctgaggcacaagaattgcttgaaaccaggaggcagaggttgcagtgagccaaaatcgcaccactgcacttcagcctgggtgacagcgtgaagctgtgtctcaaagaaagaacacatctaaggatttacatggcattgggaaacgaatggtgtattaagttttactttattattaatctagatggtattactggttttgaaaagtgctgaataggacaccaggactttcccaaacttcagggtcagccacatacattattatatactgaatgttttaaatattatttatattgacttcatattttaatgtaaatatatttgtaaaggaaaccttccataaacttaatataaatttatttttaggggaaggcttcctaaatggaaaaaccagttacataaagatagctaaaaataggccgggcgcagtggctcacgcctataatcccagcactttgggaggccgaggcgggtggatcacgaggtcaggagatcgagaccaccctggctaacacggtgtaaccccgtctctactaaaaatacaaaaaattagccgggcatggtggtgggcgcctgtagtcccagctacttgggaggctgaggcaggagaatggcgtgaacctgggaggcggagcttgcagtgagccaagatcacgcctctgcactccagcctgggtgacagagcaagactccagctcaagaaaaaaataaataagctaaaaataaaatgaaattcttggcttctggcctgatgagatgacaaatggttttgtgtctggtcgttcctgtaagtcatctgataaagctctaattcctttctgttttatttttctggagatatgattcagatactataaaatccaaacttctgtgatgtaaaagtcagtagtttttactatatttacaaggttgtgcaaccattactactgtctaatcccagaccattttcatcaccttagaaagaaacttcatacctatcagcattcactccctattcttccctcctctcagccattggcagccactaagctacttttgtctccatggatttgcttcttctcaatatttcatataatgctatttcgtataaatggaatcacatggtatgtagcttctgtatgtttcacttagcataatgttttcaagggctgtccatgctgttgcatgtatcaatatttcattcctttttttgacaatattctgtgtaataatatacaatgtttatccattcatcagttgatagatacttagagtgttttcactttttatttatttatttttgagatggagtcttgctctgttccctaggtggagtgcagtggcgtgatctcagctcactgcaacctcctccacctcccaggcttgagtgaccctctggcctcagcctcccgagtagctggaactacaggcacgtgccaccacaccccgctaattttttgtattttttgtagagatggggtttcgccatgttgcccaggctggtcttgaactccttgcctcaggccatccgcccacctcagcctcccaaagtgctggcattacaggtgtgagccactgcatccggccaaataaagtattcttaatgacatctgcaaaatccattttgctatgtaaggtaacatattcgtaggttctggggattagggtgtgggaatctttagagggccattattctgctaccacagaatataaagttgtaaaattctaccccatatttggaaactgagattcttaaattatgtctttgtaattctcttttttctttttctttcttttttttttttttttttgagacggagtcttgctccgtcgcccaggctgaagtgcagtggcgcaatctcagttcaccgcaagctcctcctcctgggttcacgccattctcctgcctcagcctccagagtacctgagactacaggcgtgtgccaccacgccgggctaatttttttaaagtatttttagtagagatggggtttcaccgtgttagccaggatggtctcgatctgctgacctcgtgatccgcctgcctcggcctctcatgtcttcgtaattttccatggaaaaaaacttaaatctttggaaggaatagagtacattattgcattttacaaagaaaaggataacttttatagaataatgaccttgtattcttttaggattttacagctactttttcacaactataggcatagaaaatgacatcaggggccgggcgcggtggctcacgcctgtaatcccaacactttgggaggcccaggcggcggatcacgaggtcgagattgagaccatcctggccaacatgatgaaaccgcgtctctgctaaaaatacaaaaattagctgggcgtggtgtcgggcgcctgtagtcccagctactcgggaggctgaggcaggagaattgcttgaacctgggaggcggagcttgcagtgagcccagatcgtaccactgcactccagcctgggcgacagagcaagactgtctcagaaaaaaaaaaaaaaaaaaaaaaaagaaatgacatcaggtcatggtgtttgctattgatcgacacttaaatagcctttgaattttgtttcaaaggagatgccagaattgcaaattttctctgctgatttgtgtcctactgattctggctcgctttccccctacactactagggctactctcactttcacacctagcaaaacttcacctttcaaagaatttaggcagaatagtcctaatttagttaataagctttcattttaaatcttagggaagcagtgttagtttcagttattctataggaacagaaattggagctgccacagccttttgaaccagagcccggcagaccctcagcttcagccctgctcagtgttttgtgtctatgaaagtctttttaattttctcattacacattttatatatcatgctatgtatttagaacagaggggttgtgtaagattatgactctatgttctttatcttgtctttgtattaatttgaagttgtgttttttctttatttgtagccaactaattaaaataccaacatatttatttttattcatttttatgtgacaaacttttaaactgaagactgcatcaataaaattgcatgccattaaatatga

SEQ ID NO: 152 - DNA, 813 bp, Homo sapiens
acccgcgcctgaccgcggcagctcccaccatggcggagaccaagctccagctgtttgtcaaggcgagtgaggacggggagagcgtgggtcactgcccctcctgccagcggctcttcatggtcctgctcctcaagggcgtacctttcaccctcaccacggtggacacgcgcaggtccccggacgtgctgaaggacttcgcccccggctcgcagctgcccatcctgctctatgacagcgacgccaagacagacacgctgcagatcgaggactttctggaggagacgctggggccgcccgacttccccagcctggcgcctcgttacagggagtccaacaccgccggcaacgacgttttccacaagttctccgcgttcatcaagaacccggtgcccgcgcaggacgaagccctgtaccagcagctgctgcgcgccctcgccaggctggacagctacctgcgcgcgcccctggagcacgagctggcgggggagccgcagctgcgcgagtcccgccgccgcttcctggacggcgacaggctcacgctggccgactgcagcctcctgcccaagctgcacatcgtcgacacggtgtgcgcgcacttccgccaggcgcccatccccgcggagctgcgcggcgtacgccgctacctggacagcgcgatgcaggagaaagagttcaaatacacgtgtccgcacagcgccgagatcctggcggcctaccggcccgccgtgcacccccgctagcgccccaccccgcgtctgtcgcccaataaaggcatctttgtcgggagtgagggtgtcctgacatctgaagggc

SEQ ID NO: 153 - DNA, 5471 bp, Homo sapiens
actcttaacaaaaacaaggggctcggggaggtttccgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgttggatgttttctgaagtggctctttttgaagtgataatagattgtaattcaaaataaaattattaatgaattctccttgtttgggatcacatcttaatttttaatctgttaaaagttcttgatgtattttaatgagaagactttaggtgaggctacagtgattccagagtgagccttctaactggctagcagaagttctctaggtttggcatctgtgccttggagatactgaaagagaatctgtcatttgacaattgacctctttgtgggatggactcattaagtatgctctcagagactggtatattaccagaatgcctattaattttcagtgagaggcaacaggtattaagtagaacagaatgctcaggttggcagattagaacgatctttcaggagacaaagcaagttttaatcagttgtttggttaataagtatggggtgttcgctgtgatagggccccgccagcttctggctcttgtggacctcaaaagtatcaggtggttttgcaagtggtggtcctttcccctgccccaccccaataggttccccatctgtctagtttgatttttgtagacctttgttttctctagttagaaaatcaggtacactgaatatggttttcatgtaacacctcttctctggagataggggtatgttttcctacccttctagtggagaatcctacttgaggatgacctttcctctcttactaaataatattagtaaatagtgggcaatatattctgctttcagattttgatttgttgagatgtaaaagttgtttggggcttaccaaatctcaagactctctttagctcctgcaggattgtattgcttttcttactggatatttttcctgggtaagcatctttgtggcttcatctcttccccctgtggttttcagtgtatttagtcgagacctctctgctgagcttgcaacctgtttattcacatggcctgccatgccacttggaggtttctgattactcccaaacctgctggttctttatgtctttctcagcgaataattccatctattcatgttggaaacttaggtgatatgctcatctccttttgcctgtttatggaggtcaccagcctctatcatttgtatgatttcgtttacactgtttatatctctctgtcccccctttttctgccattggcatggtttagacctgtactctttatcagcagaggtactgtaatatatttgtgatccctcagcttccaggcttactcctggtctctgccttcctatctacatatccttttaaaataaaattttaactatctcctgaaaaattgttgagtaggtcacgcacaatcaggagaaaaatctattcatgacatacaagtctctgtctaatctgaacactgcacctgtctctggcctttttttcttgtcatttcctagaccttaaaaaatgtgtattgagaaagaactctgttagctatacagaagatgaactgggcaatatagagtagcagcatggagaccagtctgactgaactaaggcagtggaagtgtggatgaggaagagaggtgaaaattgagaagcgctatcctttctctttgggcattattaggaggctcacagacaagtccaggagcctggttataccctcctgtgccattcaaccaggtggctttcccatgactgtgatgaataaaattgagaagcccctgcccttttcagagcagagggtgaggagaaagctaccattttgtcctcatccttacccccgttgacttggcgagagatttgacctttcaggttttgatcctgtcattttctaggatgtggtgcacgcactttgctgttgcgcatggtgaagtattgtgcctaggtcctgggtcttcatctgtttggctctgctactgtttcctcctcccaggaagtgtggttagacaaataatgtgttttaattacctgtcacactcaggattaatacatactcaggttaactgtagagaggcattggcttcagaacactcctcgtgacaattttaaccattttctttgtctagagtctgcctttttcttttttacaatttcttttatttcaacactaggtttcaatatggtgttcctgctacctcccacctccctcctccctcatcacacatgcaaattgtcagcttattgagacaacccacttagattcatatatggacaaggacaaggtattttgcatttgttactggaattcagttttcctaactatttactaccagaaatggtcaataacttactttgtgtttagcaaatcaaattgtgtgatagatagtttcccagtatgatggccagtcagtctttccatccctgtgcctacatgctgctcttcccgtccacaagtggagtctgtttctcttgagttttggctggccttatgaatggctttgcttactgaagtgcagcagaagaaatttagtatatgtccaagcctaggctttaagagactggcagctttccttttatcctttttggaagctagccaccatgctgcaaagaagctcagctggattactgaaagatgagaggccatgtggagagagactcttgaggatgagagattatcttggatgttccagccttaagctcccagctgaatgtgggtgtatcctcagctacaccacagaaaacagaggaactactcagtcgatcccaatcaacccacagactcactagaaataacaaattattgttttaagccacgaggttttgggggagggttgttaaacagtaatagataagtgagacagattgcttgttatttatggtcaaatggtgattatctctggtgagattacaggtgatgttttttttaagttatgcctatctgtagtttcctttttttcctaaaattgatttgaattattagtgtattaacagaataaagaatgaactttaaaacaca

SEQ ID NO: 154 - DNA, 1579 bp, Homo sapiens
gaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtca

SEQ ID NO: 155 - DNA, 6338 bp, Homo sapiens
acggcgcgttggagcccgggcggcgccgggaacagctgccgcggcgtcctctagcagcgcgcggctctcccgggacctgcgccggccgggggcggggagaggcggggaggggaggccggcgggcgggaaggggcggggagcgcgctcctgcggcggcgacggcggcggccgtcctcatcccggcgcttgagaggacgcggggctgcgcaaatggcttgtcccgctctcggtctggaagctcttcagcccctgcagcccgagccgccccccgagcccgccttctccgaggcgcagaagtggattgagcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacacctcagtttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagaaaagtccccgagagcacttccaggctgggcctttctctccctgttctcccacccctcccggtcagtcaccaaacaggtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaaaaaaaaaaaaaaaaaaa

SEQ ID NO: 156 - DNA, 3524 bp, Homo sapiens
gattggaaggctgccggcgtgctactgagttcggccggtccgagtcactgtgcgtcgcctgggcccgttcctggtcttctcccccagggtcttgctctgtcacccaggctggagtgccatggcatcatcatagctcactatggccttgatcctcctgccttagcctcccaagcagctggtattacagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtacattcaggatcctaataaaattccagaaacactggacaatgatacaactcagaatctattaactaaagcagttgaaacttgctttgttggacaaagctttatttttggagtgacgaattttgaaaaccaacctggacaaggttcagatgccagtaacttcttacagcaatgctctgaccacaaaagaaaagccaaagcactagtggcttgccagattgttctaccagacccaggtattgcaggctttactgtcattgactacttccatcaacttttgcagacttttaatttcaggaaacttcagtgtgactctcaggcacctaacaatcacttacttgctttagatcactcaaatagtgatctcagcagcatatatacttctgacagcacttctgattttttcaagtcctgcagcaaggatactttttcaaaattctggcagccatcacttgaattcacttgcattgtttcacaactaacagataatgatgatttttcagcttcagaacaaagtaaggcctttggtactcttcagcagaacagaaagtccatctccattgcagaggccactggttccagtagctgccatgatcccattcaggattcatggagccttgtttcatatatggataaaaagagtacagcagaaaagttgggtaaagaacttggcttacaagctaaggagctgagtgcagttcacagcagtcatcatgaaattggagttaatgactctaatttattctctttggaaatgcgagagccccttgagtcaagtaatacaaaatccttccacagtgcagtggaaattaaaaataggtcccagcatgagctaccatgttttcagcatcatggtatagataccccaactagccttcagaagagatctgcatgttgtccaccttcgttactcagacttgaagagacagccagcagttcccaggatggtgaccctcaaatttgggatgatctgccattctctgaaagcctgaacaagtttctggcagttcttgaaagtgagattgctgtaacccaggcagatgtcagtagtaggaaacatcatgtagataatgacattgataaatttcatgcagaccacagcaggttatctgtgactccccagagaactactggagccctgcatacaccacctatagctttaagatcatcacaagtaatagtcaaagcaaactgtagcaaagatgacttccttttcaactgtaaaggaaatctaagtcctagtgttgaaaaggagtcacaaccagataacaaagtagaggctgtctctgtaaatcataatggaagagatatgtcagaatattttttaccgaatccttacctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatcagattcagaatataattttgaaaatagtcaagactttgttccatgttcacagtcaactccaatttcagggttccaccaaacaagaattcatgggataaacagagctttcaaaaaacctgtattttattcagatcttgatggtaactatgaaaaaataaggattttccctgaaaatgacaaacagcaagccagcccaagctgtccaaaaaatataaaaacacctagccagaaaatcagaagccctattgtatctggtgtttcacaaccagacgttttcaatcactacccttttgctgagtgccatgaaactgatagtgatgaatgggtccctcctaccacacaaaaaatatttccttcagatatgcttggattccaaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactgtaaaagttcaggctggatttccaaatgtccagacattcaagtcttagcagcacctcagctgcaccctattcttggacctgattcttgttcagaagtcaaatgttgccttccattttcagaaaaaggcccaccttcagtgtgtgaaactcgaagtgcttggtcacctgaattgttttcataaaaagtcacctgaacccaattcctgaacttttaaatctgtttggaaatgtttgccttcaggggtacggaaagcattctttacattttgaacacttggagagaagcaaattgaaaacaggactctgctgggagctactgtgccttttaaaatataaagccattgttttccccagggttttatctagaatactatgattaggtagttgagcactttatcttatactgtttattgtactttaataatattgttaagattgtttttgaaagtattaatgtttgttaaaatcacatatacatccagaaataaagactttgcaaaccaaaa

SEQ ID NO: 157 - DNA, 4345 bp, Homo sapiens
agtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaatgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaata

SEQ ID NO: 158 - DNA, 3438 bp, Homo sapiens
cgagacggggaagccgcgcgcggggaaggagggtccaggcgtgccggacccgcccccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggtctcgcttgattgggtttctcatgggtctctggcgtttctacggcgcggctctcacggactcaggccaggccactcgcagcttggagacacatagggcaccgtacaacaaactccagctccagaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacattgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttggaaatatgacattttatgtagcactttataaaaagtgaaagcgacaaattccaccgctgcttaatactgctttgcttctttttattgacatgatagataaatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcattttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctaaatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctggaatttgtgcgttcatgctttttcgtattctttatggcttttaaataaatatacaatggttaatagtaaaaaaaaa

SEQ ID NO: 159 - DNA, 10555 bp, Homo sapiens
ctctgctctggacttgggaggctccgttgcctgctcccggagggagacgcgctgccgaggagaacccagcgggagaacatttcaggataggaataggccaagtgctgagaagatgagtcttaggattgatgtggatacaaactttcctgagtgtgttgtagatgcaggaaaagtcacccttgggactcagcagaggcaggagatggaccctcgcctgcgggagaaacagaatgaaatcatcctgcgagcagtatgtgctctgctgaattctggtgggggcataatcaaggctgagattgagaacaaaggctacaattatgaacgtcatggagtaggattggatgtgcctccaattttcagaagccatttagataagatgcagaaggaaaaccactttttgatttttgtgaaatcatggaacacagaggctggtgtgccacttgctaccttatgctccaatttgtaccacagagagagaacatccaccgatgtcatggattctcaggaagctctggcattcctcaaatgcaggactcagactccaacgaatattaatgtttccaattcattaggtccacaggcagctcagggtagtgtacaatatgaaggtaacataaatgtgtcagctgctgctttatttgatagaaagcggcttcagtatctggaaaaactcaaccttcctgagtccacacatgttgaatttgtaatgttctcgacagacgtgtcacactgtgttaaagacagacttccgaagtgtgtttctgcatttgcaaatactgaaggaggatatgtattttttggtgtgcatgatgagacttgtcaagtgattggatgtgaaaaagagaaaatagaccttacgagcttgagggcttctattgatggctgtattaagaagctacctgtccatcatttctgcacacagaggcctgagataaaatatgtccttaacttccttgaagtgcatgataagggggccctccgtggatatgtctgtgcaatcaaggtggagaaattctgctgtgcggtgtttgccaaagtgcctagttcctggcaggtgaaggacaaccgtgtgagacaattgcccacaagagaatggactgcttggatgatggaagctgacccagacctttccaggtgtcctgagatggttctccagttgagtttgtcatctgccacgccccgcagcaagcctgtgtgcattcataagaattcggaatgtctgaaagagcagcagaaacgctactttccagtattttcagacagagtggtatatactccagaaagcctctacaaggaactcttctcacaacataaaggactcagagacttaataaatacagaaatgcgccctttctctcaaggaatattgattttttctcaaagctgggctgtggatttaggtctgcaagagaagcagggagtcatctgtgatgctcttctaatttcccagaacaacacccctattctctacaccatcttcagcaagtgggatgcggggtgcaagggctattctatgatagttgcctattctttgaagcagaagctggtgaacaaaggcggctacactgggaggttatgcatcacccccttggtctgtgtgctgaattctgatagaaaagcacagagcgtttacagttcgtatttacaaatttaccctgaatcctataacttcatgaccccccagcacatggaagccctgttacagtccctcgtgatagtcttgcttgggttcaaatccttcttaagtgaagagctgggctctgaggttttgaacctactgacaaataaacagtatgagttgctttcaaagaaccttcgcaagaccagagagttgtttgttcatggcttacctggatcagggaagactatcttggctcttaggatcatggagaagatcaggaatgtgtttcactgtgaaccggctaacattctctacatctgtgaaaaccagcccctgaagaagttggtgagtttcagcaagaaaaacatctgccagccagtgacccggaaaaccttcatgaaaaacaactttgaacacatccagcacattatcattgatgacgctcagaatttccgtactgaagatggggactggtatgggaaagcaaagttcatcactcagacagcaagggatggcccaggagttctctggatctttctggactactttcagacctatcacttgagttgcagtggcctcccccctccctcagaccagtatccaagagaagagatcaacagagtggtccgcaatgcaggtccaatagctaattacctacaacaagtaatgcaggaagcccgacaaaatcctccacctaacctcccccctgggtccctggtgatgctctatgaacctaaatgggctcaaggtgtcccaggcaacttagagattattgaagacttgaacttggaggagatactgatctatgtagcgaataaatgccgttttctcttgcggaatggttattctccgaaggatattgctgtgcttttcaccaaagcaagtgaagtggaaaaatataaagacaggcttctaacagcaatgaggaagagaaaactgtctcagctccatgaggagtctgatctgttactacagatcggtgatgcgtcggatgttctaaccgatcacattgtgttggacagtgtctgtcgattttcaggcctggaaagaaatatcgtgtttggaatcaatccaggagtagccccaccggctggggcctacaatcttctgctctgtttggcttctagggcaaaaagacatctgtatattctgaaggcttctgtgtgacaggaaacccaagcctaagaaacaattaagtggttctcatctctaattaactgtgaaaccatttaatccaaacatgtaagcacacactcacttattaagtcacatacttttctaggtgctggggattgagaacgaatcgatgtaagattcctcctttagggcagagacagaccactgacaaatacacagatagacaaggaatttcccatggtaaaaagggatatcagtaattagaggaccgtgagactcagagatgtgtgtgtgtgtgtgtgtgtgtgtgtgtgtgtgtgcgcgcgcgcacgtgcacatgtgtgtaggtagatggagggggtgattattttgggtggtcagggaagtgctcagtgagggaagaacttgtcatgagaatctctgagcgtgccaggcagactcggatatttttataaatttttaacatggccacttgcagaagagcttgaatgggacgtgcagcgagaatgtgaaggatggagcaggtagctcatctggccttgtaggtgccgggaacgggcaagacatgttttgaaatgtaagatcacagactgttttttgcaagaccacattatattactttattattttctgctttttcttttaacgacattagtgtttttgatcactatattttaaaatgctttttgtgagccttttggttatgtggaatctgttccttagctctgattttttattcttatggagcgtcttaggttactacatgaaggtaagactgccacagtcccccagggaggcacactgtgttttactgattgatttgaagatgatagagagcctagggggatgagtctattggactcaaaggttacattttgtttttccatttaatttaataatcaacaaaacgacaaagtcagtttaatatctttcttctgctgagtcttcaggatgttagctagtctttcaaaagccattgctacaaaagtgcaaatttctcatttcctgtgggtctctagaaactctctcaatatttaaagccaaacaaatccatcttttctgagagacagaaactaaaaaattcagagttaattcactattaaaaacagcaaggccctgctatttcccaagaataaagaaatttaaaattctcattgtaagaagtatgaacttgaagctagaattggtttatttctggcagctacttacaatattaagaactttactttttaaatttgagacaatttcacaggaaagcaagaaattagtctattgtgaaatgtttttacaactaacttggaatatactgcaaatcactagtaagtagagacacatttaagataaaatgattaataaaacaattggtaattctgaataaggatctgaataaatccagatcacagactgttcctttaccaatatgtaaaagaatgtgcaaaattagtaaaaatatacccaaaaatttaccagcaacagagaagcaaagaatggagttcaaccttacactataaacatctaatagatatgtatgaaaatttaaaaactagaaaaggttgggcatggtggctcatgcttgtgatcccaggactttaggaggccaaggtgggaggattgtttgagcccaggagttcaagaccagcttgagcaatatagtgagaccctgtctctacaaaaacaaacaaacaaacaaacaaataaataaataaataaaattagctgggaatggtgatgcacacctggagtcctagctactcagaaggctgaggcaggacgatcacttgacctcagaagtctgaggttacagtgagctatgatcataccagtgcactccagtctgggtgacagaacaagaccctgtctccaaaaattaaataaataaaacaaaaaaaaagaatttaaaagttttatataaaggcatagctactatctcatctgcccagtgtagtcatgaatagatgtcacataaagaaaagaaaaccagaattcttgttaatatggccagtttgaagggtggtggcggaggtattgagcaggcagctcagggaaatgccagggagacccttgagcacagaaactcctgattgtccccagggactctccgtggacacaggagggattttccaggatttcacatgaattcaatgaagggggctgtgtcttattcctggatgctttgcctccttcatggaattcagtggatttaatggaagttcctaggcaacaataaagagtagaaaccaggttaacagcgagggcctcatctcacaccagatcatatcaggctacacaaaagtagatggaagacaccacccaggcctccagctatacactggagaagaagccaaactagtctacttcatctaagaaagttgtcaaagagagcccttctatactatcttaaggtaaaaagaaagactctacccagctgccctgattaagcattagaaagataagtgttctgatcattaggcgaaagacaatggggaaaaatgtagaaaagaaatatgacatgagccagatgaagaacccatcctgaaaggatatataactcaggggacaaaagacaactcaccataagttgggcgcagtggatcacgcctgtaatctcagcattttggtaggccaaggcaggtggatcacctgaggtcaggagttcaagtccagcctggccaacgtggtgaaatcctgtctctactaaaaatacaaaaattagctgggtgtggtggtgcatgcctgtaataccagctactcagaaggctgaggcaagagaattgcttgaatcaaggaggcagaggttacagtgagccaagatcaggccattgtacttcagcctgggcgacaaagtgagaccctgtctcaaaaaacaaacaaagcctccccatagatgtctcctgccatagaagaatttaagaagttcataaattcaataaaacaagagttgaaggcctgtcccactgtacccaatttctccctctctgaactgcagcctagaaactctctacaggcagtaagctggggcagtcacagaggtgacctcatctgtttcccacatcctgcattaggacagtgatcagggatcagtatccttcattgactgatttccaatatctcgagacctgttgtttcatatattttgccttattttgcaattgtttcatatattttgtcttattttgcaattgtttcaggagggaggataaatatggtccctgttcctctatcttgaccagaagcatctaagaaggcagtgaagcaacatgtgtacagttcttagggaaacaaattttgacctaaaaatattaaacctagtcaaaatattattctagtacaaaggcagcacatgggtatttttgaacataaaagagttctagaaatacaggacccatgaatcattcttgaagaaaagttactcagtaaggaaatctagctaagcaagcaacatgtacaaataaaagattattataattggaccaaagttaagtttaaatccattcacatgtatataattaagatatataggaattataattacagaaaagaatgttacaaaccttcacaaagtaaaaatatttttatatcagatagattcttctgtttcaatccataaaaccagggtttggatcattttaaaaaaacaaacaaaaataatttattggaatcattagggaggacctgatagaataaaatgacaagctgaccaaataggccttagaagggagaggtgcctgggcagttacaaggacctaggtagcaggggtgacttggccacagtcattttctttacttgatttaaggaggttaaattacagtgagagagttgcacttatttagtttgcataccgtactcaactcttagctagcatagggcaggttccttagttgaaaaatttccacaaaacatgatgtaaagtggaaagatcagttcccccaaagaatatcagttaccaaagtaggatgaaaggatgttgggtagatcaaaacaacaaatgtccattacagcaattaacaaaagttagggagtggggaagtctgagtgctaatatggatttcaaaacaactttaaaaatggcttcaaacattttatgctttttgtaatttagtcattttaatattagataaatcttcctgtaactgaaagttcttgagttaaagaaaaatattcggtagttcagctcttccttcaattttattagttgctttttcttttgttcaagtgaaataaacataaaaataattttaaaatattatgtatcatatccttcgatttaacataattctatctagctgttcttatattttctctgatatatttttaaaagctttctggaatattattaaccttgaatatttctagttgatgagtttatgagtgatttattgcttccttttctctttcagtattgctagaattaattttattgactttgcccctttgcataaagaccttgaaggtcacatgctgaaatcgccctctactaaaacaaactcatagaaataatggggaagatatttcaaaacattgccatatgcatagccatcctcacaaccaagaaaagcgcctctccatgaactaaaacctatgagtcattggtacaggtagggaaaatctaggtaaaccacggtaatacactgaggctggcaccaccacaggccaggacaaccgttgtcacaaagccaggacagaatctcccagccagaaagtgttgccctgaggctgaagccaaattcattttgcccccagttggccagaccaaagcctagaactaaaaaacccatacctcagggtttgtcagcattggcactgctggctttttgggctggacaaccatttattgtgagaggcttctctatgcactgtaggatgtttagcagcatccttggccctactccctagacgccagtagcaaatccaccaccctccctcccctaccccagggttggttgtcagttgtgacaaccaaaaatgtctccagacatcgccaaatgtcccttggggggtaaaatcaccaccaccatacctcttttgactaaaagagtttccagaatagtggcagaatatataggtcaagcataacacattacaatcaagattcagaacatcaaagattcttttttaatcctaaaagaaaaagtttggaaaatctacaaaaagaagtgtgaatttgacaataactatttcactagcaagggtagacgtaagcagaatacaggtagcatattcaaactgctgtggaaaaacaacatcaaacctagacttctctccccaaactatcattcagagtcgagggcaaaataaatagattttctgacttggaacaagtaggaataatgtacttatagtattcatcttcatacagggatggactataagtgatttttaaaaaacttcctacttgttccaagtcagaaaaactattcatatagggatgggctattagcaagagtatatgaataacgtactataacaagaaaaaatgaattgagaagaaagtagtggttttaagaaggaaaggagaacaaataaattagtgaaacataaggttaagtctatacatattattttctaattgcctattatgtcagactacatgtagttagaaaatacgatgaaagaaaaagccatattataattccaacaaaaagataaaataattaagaataactgcaacaagaaaatataagttctgcaacaataaaactatacaatgaaactaaagagcacaaaaaagaacttaaacagataaaaagcagaccacgtttttggataagaagattaaaaattataaatatatcaattttcactgttaatctataaattcagtgtaatcccaataaaaatgccaacaggttttccccaatagcattgaaatgattttaaaatttaatgaaggccaagcatggtggctcactcctgtaatcccagcactttgagaggccgaggcaggtggattgcctgagtccaggagttccagaccagcctggacaacatggtgaaatcccgtctctatttaaaatgcaagaaattagctgggtgtggtggtgtgcacctatagtcctagctactcgggaggctgaggtgggagaatcacccaagccttgggaggtcgaggctgtagtgagccaaaatcacatcactgcactccagtctgggcagccagagtgagaccctgtctcaaaaaaaaaaaaattattggaaactacgaggcaagaatatccaagaaaaatctagaaaagaagaaacctgagtgagtcagcatgaccaaatattaaaacatcttataaagctacaataattaaaacaatgtggtgctgatatgtggagggtcaatggaacaagatgaaatggccaaaaataaatttaaaatacatgttgaaatgtattaacagcatatgttaaagttaagttatgttaactttatatgttaaattcaagttaattggggaaagatggattattcaatatatgatgaacaactctgtcacccagctaaaaaaaattaagcttgggccatatgccagactagataccaaaataaattccaggaggaccaagtttttaaaagtaaaaatatggaatcatggaagtgcatgaagaagaagtagcacttaaaaaaataataatctcagcatggggaaggtctaagtatggccctcaatcagaaaccaggaaggaaaatattgactattttaaacaaaattatctctgtaccaaaaacagcataaaaggtcaagaaacaacacactggaaaaagaattgcaatgaatatcacagccaaatagttaatttcttattttcaaaaaatagcttctacaaatcgaagagaaaaattctaaggtctcaaaggaaaaatgagcaaaggatttgacaggtggtagaatacagaaaaagaatttaaaatagctcctaaagatatggaaacattactcatgatagcagaagtatcaattgacaaaattactcagattggtaacaaactttaagggggaaagcacttccatgcattgctgtaaattggtacatcttctactgagaacaatccggcagtagttaacaaaattgtgaatgcatatatctctttctctagaaatttctcttttgggaatttattctacatatatattcaaacgtgtgaaatacttctatacaggtgattgaatttcactttattcctaagagcagaagactgcaaaatagtaaatatatacccaaaagggtctaatggattagtttttggcatatcagcacatgataatactatgaagccataaaaaagagagatctctatatgtattgatgggggaccatctttaagatatactgtggtgttgaacaaaacaacatgctgaaaatgtctcttattcttttagaatcaatataagtctgtgcttgtaaatgcagtaagtatctttggaagtatacctaaaaattggtaatagtgtttgactccagggaagaacagatgggtgccagagtgaaaaaaagatagcttttgctttttatgacttttggattctgtaccacgtaataattttgatgtaaattttgctgtgtgtgtttttacttgttcatgtagtgattttataaattactcttttaattttctatcaatgaatatcctgggataaacccctcatgatcataatgaataatgatgtgtggagagtggggagggtttacatatgaaaaatgtagaaaatacaaaaagtgtctatatatacaaaaatgtaagtgttaacatttttatatttgcttcaagctttttttttaaataaaagaaatgcaatattgcaattaaa

SEQ ID NO: 160 - DNA, 3309 bp, Homo sapiens
ggcggagagaataaagcagaaagacaggaagaggaggtggagttctacagttagtgtggttttagtttttcctaagaagtggcgtggtttggggctttatatccgggaggagcatatgtacgcaaatcctggggcgtttgcaaacccggatccggggcgtctggccccatgcccggccgggcgtttgagggctactgccacgcagcgtttctggagcctgccggctggtgccctggtggcctttatctctgtccccctttgtcctctttatctcaggctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaactgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattagatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtataaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgatcgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaaccatgaaaaaaaaaaaaaaaaa

The invention claimed is:

1. A composition consisting of pairs of oligonucleotides allowing the detection of at least 21 genes belonging to the group of 160 genes as set forth in SEQ ID NO: 1 to SEQ ID NO: 160, said at least 21 genes being the genes of the group consisting of the genes as set forth in SEQ ID NO: 7, SEQ ID NO: 11, SEQ ID NO: 14, SEQ ID NO: 15, SEQ ID NO: 20, SEQ ID NO: 22, SEQ ID NO: 28, SEQ ID NO: 30, SEQ ID NO: 34, SEQ ID NO: 40, SEQ ID NO: 54, SEQ ID NO: 72, SEQ ID NO: 74, SEQ ID NO: 76, SEQ ID NO: 100, SEQ ID NO: 102, SEQ ID NO: 127, SEQ ID NO: 141, SEQ ID NO: 149, SEQ ID NO: 150 and SEQ ID NO: 160, wherein the pairs of oligonucleotides are attached to a microarray.

* * * * *